United States Patent 9,976,180 (METHODS FOR DETECTING A GENETIC VARIATION IN SUBJECTS WITH PARKINSONISM) - sequence listing, part 8

SEQ ID NO: 72 - DNA, 18527786 bp, Homo sapiens (residues 8,234,573-10,293,215 of 18,527,786)
  misc_feature (4041202)..(4061201): n is a, c, g, or t
taactttaaaagcctcagagaaaagatgtctcctttgttttacatgtcccccttcacttctgacatggcacccaatcagcatgacttgatagcacaaaatagggcaatgctgaatgaggaccctccagtccctgccctcagccctcatctccctttttcctgccttctctccattccaggagactgttgttaccacagccctggaattcctagcacacatcacaatggccacctggaagttcacgggaaggaagctcaaccccctgacatcaagcaaacggttgttagttcatggcaattagcagctgtacttgaggctggggagctgaagtcatagtccaggctctgacccttactggtagtgaaacttcaccttgacccctgtgcttcccactctgtaaaatgaaggtgggaacagctcgctgagtgactgttgtggggattagatgatatttgtggaagaactttgtaaggggtaaagaggtatcaccttataaggtaatgtcatcatttttaaggtggggcaagtgacagtcagacactcaagttagagcaaagccaggagaaggttgcactggcatggaaaggggtaaatagcccacctccaccagcctctctggagggtcaactccaaagttattagagttttaagttttgggtaaaaaatgtttgtccttagagtaactcctcacttcttcagagttattatgtccaaggtgttttgttctgtttgtttgttttggttttggtttttgcttcattttgtttttctgagacagagtcttgctctgtcacccaggctggagtgcagtggtgcaatctcggctcactgcaagctctgcctcccgggttcacaccattctcctgcctcagccacccgagtagctgggactacaggcgcccaccaccacgctcggctaatttttttgtatttttttagtagagacggagttccaccatgttggccaggatggtctcaatctcctgaactcgtggtgtttttattttgaaaaagggaaaaatacgttttatgccctgaggtctaatcacaaaataccttcactcttcaagtctgaccaggagccacttgcctcagaatgacctggagtgtcgttcaaatgcagatcctcaggccccatccttgactatcacttaatttttctgagcctcagtttttgagttttgaggcgtgacgtaacttttgctttaaacctcagtaagagagtttcaatagaaaaaaatgaacaaatgaaaagatgaatggcttgcaagggagaggtagaatatgtatccagacaagatgactcctattgtcccatccaaatcagacctccattatcccaggtccccaaagatgtcttcagtctcaaacaaccaacagagtggccccattcctatccactgtgcatcctggccaagtgcacagtaagtggacctcttggccgggcattctgccaatgctggagctgttaggaaataagaatgtgtgtatttattgaagaaaataaaaatgttcatgcgacgttgcacagagacgatttatgagattttatgaatgtgtcaccaaaagacccactcagtcactgccaatgttaggtctgcaaacacctgggggctcaggcaacaaagctccctgatggagtcagtgggcaggacgtgcttgtggaggggagtatgagccctgtgctgcaggtgcctgcacctgtgagttgtgtggagccaagtacacttaaatcataagtgtatatatgggtgtaaataaatgtacacacactagtggtgtgcaagggagtatgcatatatgtggaccccatgagatcgcatagcatgggccactcctggtgtgactaggaagagaggctaagccacagtgcagaagtggacccattactcacactaccttcaaaggacacagagttctcgctgctcaaaggaaggggttagtcatcacctactgctaagaccaaaagccttggggcatcaagaaaagcagattatcaagagaaaaatgtctctagccgagcatgcaagaatggatagagtctgaccaataggaggaagagcagggtcccatcttgctcacctcctctgctgggcctgaacttctcattgacattatagcctattagttccaggtctctgaagcctctctgagttctgtgaaccaggtttatgccttaccgccctcctgggagcattgtcttgtgctctccagctgccaggctggtgcaaaccacagaatgaacaagctctcctactaagccccttggagcctagagtagttcactgttttctgagggttaccttctatgggagaaagttcaagaaaatgcatagaaggtatgttattaaaagaaaagggaagaggaagagaaaaggaggaaggagaaggaggagaaggaaaaggaaagcaagaaagaagtgcttttagggtgagtccctgaatcacccagagtccatcttcataaaaatagccttaagaccccttgtgggccatgcaagaaggaggggtgcctacttcctccctccctttcattcctctgcaacaaggagagaatcataggttttgcaagagccctttgtttgcctggggcacgccatcatcacatgcatcttctcaggcacgtgagggaggtcacttccctacgagacagggaggaaccctgggcaactgtggcttggaaatgaaaccagccctttcaatgtatctctttggtgaccaggatggttggtcctgcttggagtctgaggttagggggcaagattctgtgaatgcctaccctgtgctgcatcctcagctgggcactgtcccataggctctttagtccccacctcaacctaaaagaggaaactagtgtagccatggcatacatggctaagattttaaggatccaaggggctgtgacattggatcaaagacttaaaggtggcaaatggcagagccgtcttccaggtggaaccagagacccattcctcttgtgctcccagcaccaactgcttccctccctcagagcctttaaaacactgcactgcttgtctctctctccattatcctgagtgctcttgcaggtcaataactagttctgcactcctcatcccagaggtcagcacaggctggcatggaagaggaagtacctatgaaatggcttacagagggaaggaggaaaaatggaagtgtccaggaagatgcatttctacccagcatcacccctcctgacattaggaactagttaaggctccctgatggccagaagcaagagtcaacatctctgcaacgtaagccttctggtatctgatatccccaccatctgccctcactcttgccccagagcgtctccaggtgagcagagattatgattgccaaagggagccatttcaggcctcagacccccaagcttcaccagagaaagcccctgtcctggtaaaatatgatgtcactttcccattcagccttggttagctgttctatgagccaggcagagtagggatctgttcatatctatacttgcccccagggagtagcaacaatggactcatgatataagaactcagtgaccagtggtacctgccagtggcccacaaaattgtattgttgagctgacttcctccaagtttttggagggggtgggtggaaccagagctgggcctggttccactgcagagtgtgcaggtcactagaacaaccaggagaaggaaatctaatggctggatcacagttattgatgttacacctctgaccttttctcaaaacctttgcaaaccattgtttggatttgcaatactggaaactatcagcggaaggtcttgactgtgagcaaagataaagttatgaactctgggaactgcgctgtgccagaaaagtgcttcccaaggtttcatgtgcagacaaagcacctggggatcttgctaaaatgcagacactgattcgataggtctgaggtgagacctgatgctatgtttctaagcaacttttgggtgatcctgctggtccacggattactcctggaagagcaaggggcccaggctggagctggctcacgctggctaagactaacattctactcacttccttgcctcaacacacagaaggagcccagtgcctgttgggaatatccaaactctctaccttgcaagattccttcccagccagaccctacttcaccctccttccgccacctccccgcagctgtgctccaagcacaacaaatggccagatttatcccaggctagtcaagctctattccactagcccatccttaccagtgctggttcctctgcctaaaatgcccttcttcaaggctttggaagctcctactcatcttccgtcacactttccccagtacccgttctgcttctgttgcttgccacttgtatgcaaattacttcctctctctaagcctcagtttcctcatctataacttacagatagtaataatgtttaccccaaagggggttttctaaatattgaaggagatgatagacataaaatgcttagcaaagtgcctgagacattctaggtaattaaaacagtaaattgatgtaacttccctctgtgaaatctttctggaatttttccatttacctgatttttattgctcccacaaaatctgacttttacttctatggtggcccttatcactgaattttacaatggcctattggctctagactgtcttatctaataagttacaagcacctagaggtcaggttcatgttttacccacatctgctttctcgggatctagcccagagacaagtacagaatgaacactcagcaagtagaggccaggacagccacagccagtggcatttaggggtgctctgtatctaatggtggcataactcacggagcagtacagttaactggaagattcaggaaagcagtagctctatttaaatgagatgtccagataaacgatgatttcatatccaggtaagacattactctttatttactctttatttttaaaggatttaccaagattttcttaagtggattccatacttaaacagaacacagtggtctttatataatctttccaaaattgcttggggacacctaaaaggcattaatctttgcccccagagacagggcgactgaatacttggtttgtctgggaccattgttttgcactcattggctggtcctgttattcctagcatcccattttattcttttaaggtctcctagtttggacaagaaattatcaggtcaccctaaccagtgatagatgatactggatcaaagtaatggttcaaggaacccctgagatggttacatatatttgctatttgtaaatagcaaatttacaaatataaaatttttaaattttatatttaaaaatttaaaaatatagcacttttttaaaatgcagcacttcccattgaaagaaggagtctccgtcccttcccttgaatctaggcagctttatgacactttgaccaataacatatagcaaaagtgacctcctgcaagcttcgccaagaccttaagaaattggtgaattccacctcttgtgacttaggatgctcatgattagaactcagccaccatgctgtgaggaggcccaaggtatgttgtggagagcctcctgtaaaggggaccaagagcgagaaccctggcgccagccttgtcagtgggtcatcccggcagtttatcttcagcctcacttgagctgcttcagctgatgctgtgtggagtattgtgtgtcacttccaaaccctgctcaaattgcagatttgggaacaaagtaaatgatcgttgtttccagttattatttgaagagtatctttatgtaataacagatacttagttgcccagaaagaaaatcctgccagaaaattcagcattttggactggtagacacctgatatagagttgggaaagttcctggaacaaatgcttgctaccatcatcataagtatttatatatatatatatatatatatatatatatatatatacatacacacacacacacacatatatacatgtgtatatatatatatatatataaaactgtctttggtcagaaatgttttgctagggatttcgccagtttggtgacaacagggtttaccaaaaagtgttcaccgttcaccctaagataattagcagcaaacctagtaacaagatgagtcactctgagatggtgacatgaaggattttcataaattgctctgtcatcttccttctacataatcatgaccaagtaagtcattttacctcttgaatcaacaatcaaggtaatttgtctgtataaagaacatacacagcacaaccctttctggggaaattgatatttcagacccggagctcagagattttctcatatgtcaaccacatctttcagatgagagccccttaaacaggaagtttggaagagttcagctttagggcaaaaaagggaagtgaataaggagggagagagagatgggatgggaggggcaatgagggaaagagtctggaggaaacatgccccttacaaattccaccactcatgggtgtcccaatcattcatttgttcatttagcaatatgtctcgcctgccaaccatgtaccaggccctgggctgggagtggagcaactagcagtgttcaagacacacttgatccctgccctcacggatggggcccacagccagtgaggggaagaggccattaagtaagatgtggcagtaatagtgtgtgtgttgtgaaaagggaagtgaagggtggggaaccacttgtgggggtgaagggactggccaaactgggggtcagaaaaggactccctaaggaaatgacatagaagccaaaaccagaaggatgagtggggattagtcatcctttcctgccttcctcctcttcttgaattcacctctgtgcttagagtaaacgagtcctctgactttcatttgtacacacaatccttcctcctctcgtctcctgcactgagctttatcttacctgcactgcctttaaagaagtctctcttcactaaacctctgcctgaaacttcattgcttttagggtaaaaaccaaaggccttaacatggcttactaactctgtctgtcattggtaacttggcttcagccaccctgcattttcttcctgccacaggccctttgcatatcctgttccctctacctagaacactctcccttcctctgtttacctagttaacttctacttatccttcagatctcagatcacttattttctctggaaagcctccatgacctccctcaactcattaaaggctcctgtttttaaggtctcaaaacccatgtacccttcattcttagcagtcatgataggtgcaatttctatggtttgtatgataatttgaccaatgcctgtctccccagggagaccacaagccccagaggaacatgggcttgtctgccttgtttactgcttcattccagcaccagggtttaacatgaagaaacaacctaattaaatgttggaggcaaagtgctgacgccagagtattactacttccaaacccttgagaataaaaaaaaaaaatccactcagtaaactcatatatatcctctgaatcaagttcataatagcagttgtgacatgatgaggggggcagaaaaccaccatggagccaggagacctaagttagaatcccatgtctaattgccctttgggtctaagtttcctcatctgtgaaaaaggtgaaataacagcattctccccaacaactgcttagacttgcttcgcctaatgaaaccacttcaaggatgtatacttatgagttgattattgcccaatgtccactggggaatcaagaaaggccatcagtacaccaggccccactgttgtgtgcagactctgcatgggacaggaagcatcagctcttggactccccaagaagggcgtctgcaccagcctgggctaccatgggccctgcagtattgatcaccagtattgcagagggaacatttgcctttattcccctttcaaataattaaagtataatattttatggcctgataaaatttactgagacccttggcacgtaattatagtgcttctttaaaggagaccccataaaagatgcatgattagaaagttaaggatctggatagaattgcaacgatgtgacaaataatttacaagtgataaactgtctgagggggaagaaattccaataacctctgatgaaggctaacaattaaaataataaattccccaagatcaagggtaaaccttttttcttggtcaaagacttagactccacaggcccaggaacaagaacaaaccttcttgtcaaagtcaagtcctggtttctccggacatctgttctttatttctttatgtgtctatcttttgtatgtaggcatttacatatttaacttttttcttaatttatttatctactaattattcatttttatttatagccattctttcactccctcattctattaattcttccttccattcatctattcacctgccccatctatccatccttctatttatttattcatttatctctctattcatctattttcatctgttcgtttaaccctttattaatttactaatttatttatctatccattcatttacttttatttttcctcctctacttatttacccatccattcccatctacatgcattgctcacttgcggtaagcagattgttaactgtgtcctaaggcagtgccacccagtagaactataatgtgagccacacatgtaattttaaattttctagtagccatatttttaaaaataaaaaagaaataagtaaaatcaatttaaataataaagttactatgtaataattatttttgttattataaagtgagtattgtagcatagtatatatttattttaatataaaatacaaataccattaatatttaatacttttttcactcgttttatttaactcaacatattcaaaatcttatcatttcaacatgcaatcaatataaaaaacattgagttattttgcatgttttttgccctcagtctttgaaatccactgtgtattttgaacttgcagctcagctcaatccagaccagccatatataaagctctcaatagtaacatgtggctcatggctgccatgctggatagcacagctctaggacttcagagatgaatcagacatagcctttgcccttggatagtttacactagggtaaggatggagaacgtattagttcatttaatcttcatttaaggtataagtacatgatactcccattttacactagaataagccaaacctcagaaagaagcagtaaaaagttttggaatcaaataaattgagcctcttaaactactgtggcaaacactcaggcagagcttatgctgtgtagctatgaccaactgaagggaatcatctcaccttcccaagagctggcaagggccaggcatcaggcaagacaccactgggaagaaacaattgcatcagcttggaagtagggaggcagatacacaacagaggaggcctttccaggcaaagcagacaagcagagagagaggagaaggaactaatactcctcaaacatctgttatgcccaaaccagtccctgagttctccaaatatctctgcacagagactcgggatgtgaaagaatatatttcagagaataaaaaagcccacatggattataactagccttctgcatcaaaaattatagtgtcctatccattcataactaagagagctaggattctatggccaattaactacaaggcacccaagcctgaagagtatgatgatgatgacaacagtgataataatggtaatagcagttacaagagctcacatgactgagcattttctatcgtattccaagcacttcacctgcgctggttcattgatacacttattttagagatgaggaaactgaggcactttcccaaagccaccaacctactgagtgagtgttacttacatagacccccataaagagcactgaattggaaacagactcagccagataggatagaggctgcaggatggccacggagggtgtgaattaagtacccctggatcattgtttctaggaagtgcatagtcccctaaagaagaaaaacctatgaacaaataatgaccctaaagagttctaggtgctctgtttacaatagcaaagacttggaaccaacccaaatgcacatcattgagagactggatgaagaaaatgaggcacatatataccatggaatattatgcagccattagaaaaagaatgagttcatgtcttttgcagggacacggatgaagctggaaaccatcatcctcagcaaactaacagaggaacagaaaaccaaacactgcacgttctcactcgtaagtgggagttgaacaatgagaacacatgggcacagggagaggaacatcacacaccagggcttgtcagggggttggggacaaggggagggacagcattaagacaaatacctaatgcatactgggcttaaaacctagatgacacgttgatgggtgcagcaaaccaccatggcacatttatacctatgtaacaaaccagcacattctgcacatgtatcccacaacttaaagtaaaataaaaataaaaaagagttctaggtgctgagccagacatccatacacagtggagctcacatgtgaggggagctgtcacttctctttagggatgagagaggtggtcaggaagggtttcacaaaagagatgatgctcaagcatcataaagctttctctgattctcccaacaggaagtaatccctttcccttctacaagtaagccactttgttcaggtccttggagcctgggccccattgggccagtttcagccccctcctccttcctcacccagcacagcccgctcactctgtgattccctgcagacaccaggcaagctttacacttactcagcatggatcaatggagaaatacaatcacttggatttctgagaatgtatatatttgtttagaaacccctgtctttctcgggtacagacaaaacactgccggcttaccacctcccagagacgcactgtgggaatgatttaaaggctttgactgtcagtagcaatatcaatcagacgcgcttcccagcggcctctgcccaggaacagaagagacatcaggcaaaggggcggaaagagggacatagcactggaaccaaagtcaggtggagagagagagataaaggggagggggagagagaaagtgagaggcactaagaaaacacagggcaggggtgggagtgtgcaaaaaaagacaaaggctgggaaaaagctattcggagttagggagactgaaagagtcaggaaggggaagaaaataaaagagacagagacaaacatggccagactcgaagtaagtcaatcagacaccaagatacggatggggacaaaaatgatcaactaaggagggaaagagggagagcaagagagcagggacagacagaaagagaggagtgaaaggagacagggaagcatgtttctagcacgctggaccacaccagttcctccctgcctgcactctgctcagctgttccctctgcctggaaggctcttcccccagattcttgcatagctggcttttcctcccctttccagcctttgctgaactgacactacctcaaaaagttccccagtagccaccccaatggaaggaaggtctgccctgctcatccctacccattgttctgcatcagaaaagaacaccccactgatttcttttatagaactcatgtaaatatgttattttcttggctttttattattcacttggggccaccatggtcctggcatatccccatgatctagaacagtgtctgtgtctgacatagagcaggtggtgcttcataactgaagaacagatgagtgaatgaacaaatgaacaatagtaaaggtaaaatcattactgagccaaagcacttctctttgcctactcaggttactcaggttgtaatagtgcgatttggtggcagggttgggtgttgactggcagtgcacgcctgttctcagcagctgggcaaaggcggggctatctgtgatggaagcataggacaggagcctgcatctgtggatggagctaaagaagattctggggagactgtggggtggctggagagctgggaattttctacctgcagaggcccctctgcagttcctttcagacatgaatggttccatccatgatattgccttgtctaaagttgaaaatgaccctgtaggccaaagtgcatgattcccacatatatttcttgggcagccaaatttcctaacttaactaacgaggttcccaccagcctcattaggcctaagatggcttccccatcatgaaagctctttgtttctatgaaaagagctcttaggagccattgagcgagatcagctcctgctgatcaatgctgaagagcactcatggggaaccttccagtcaagatcagagtgctttggcctcccaaaaatccctagtaaaggccatttggctttctgaagccagacaaaaggcaattatatgcatttctatctttggaaaatgtatttgaggaatcagtggtgaggcctgaatgcaggagatgcagagagtctggactgcctggtgaaaaggatgctggccatgaaatcccaaagtcaggggacctcttcaggtcacttacagggtgactcagtccaaatagcactggaggcgatccacagcctgccacccatctcaaccctttcatttcgcctctgacctttctcttcttgcccatatttgttcttgcataaatttaacatagttacattcataaattccagttaatattctgctttctaggtaatgtataataaacatcttgtatgtttccatgagatctttgtcatcaacactgctgatgattacattggtgcaccatgatttcatttaccacacccttgtaaatgggcctttgagaattatctagggttttgctgttctagatattgatgtaacacacatcttttgcttatagctagtcctttcctcaagatcattttcacaccttgaatatcagggtgtgacaatatgttctcatattgtcccaaaagcttgtaagaatttggatggtcacaagcagtgcatgcatgattttcattccaacctcaccagcattggtcattaataacatttttttcttaaatgattaacgtaaatcattttaatctccttggttagaactaagaattaacatttttgaaaatgtttgtttaatttttacataatttcatatgtgaatttttgtttagagatttgctcagcccatcccattcctatctgcatctgtaaatttagggtgtaagtcaccatccatggccacctctgaagaataaagaatgatatattcagggggtaaagttataaactgtgggcagtactcaaagcttcaaatcaagtccttgcaatggagtaggggcagcctcattaacaaggacagccacactttccccagtcaagtcttgatataccacaggactaagccagtgggtcataatatttatgcactctgtgcctcaggcactgtgctaagcactttacatatatatttcacttaatctttacaaggtcactgagatgtagacattagaatttccattttacagatggagctgaaataagtaaagtaattgccccaacatcacccagcctagtgaagattcaaacccagatctgtggatccataaagctatgatgtaaccactgcattagcttctgaataaataaaaaaaaaaatcaaaggggttaaaaaattgaaaaacatgatactgtctctaccctacatgtgatcaccagtctcctgaatagataagtagggagagccacaaagccatgtgacctatgtcattacaggtctttgaggtcaggaagccatgaggacagaggtgagaatccctcactgaggagctgaggaaggcttcatggagaaggccatgtcccatggagtactgaagcatgaatgagaatttgcctcatggacaagagttgggctgaagagagaaaggagggctgagagccgggtctcgccaagaatgtgtgcccgcaggttggcaggacttacgagtaactacagaaggtaagttttggactcgaatagacctggttttgaatcctgcttcttcttgctagctatgtgattagataatcatttcagtctctgagcctcagtttgcccatctgcaaaacaggcacgattgtttcaccagttgttgtggagactgaagagcatatggcagtgatgtgctcaggctggtacctggcagagaatcactgtgctgccatccctaaggacctcccacttttcttgtgcctcatcttctgcttctataagcaaacctgagagcgtgtcccatgagaagtggcctccaaggacacacagctgggagcacatattttctgcccaaaggaagcaaccagagtgcagtgaaaatcacctggtcttggatttagctacacttggttttgcaccccatttataccacttactagcttggacctcagaatgtggacaagttacttacctccattgaggctcagttttatcatctgtgaaatggggacagtcagccctgtctcacaggtaataggacacatgggcccagtatcctggacataatatacatcagtgtgcaatagaaggtccccaaaaccccacctccttataatcaacacatgtgggcactgactgcaatggcctacaagagatgtccatgattatgttcatctacagcccccatctagggacatccccaaaggcccctggggcccttcaaccttcagggtgcccagcctggcagggcctatgagcagtagctgtgcctctgccccggagaccaacttctccacatccccccccagctattgcgggaagaggcatgactcattcgagggaagagggttggcaccttctcccccagccgcatggggccagccagcaggcctgtggttaaaggacctgcctggattgcaaaacaagccagtttgctgcattctggggtcacgtgatgcagccgggcgctgtggatggccttttcttccctcgcccactgactcactgcatgcttgcttgcaatcacatgggctccctgggcctcagctcccccaagtgttctcgttgctgagctcatttggagaagaactaaattggaaggactacttccttttttcccttttttattgcaccatgactatataaatatattctcattatgaaaaaagtgtaaagactatcaaatatagaaatatagaaatgggaaaccacccctcaggccctaccacatggcctctgcagttgtaaatatggttaatattttcctgagtgtcttcaagggctctgtcttattttttaattaatgttagtttacacaagaaactaacattcctccttttagaaatattagaatattactaagaaggcaggagtcctccttgacgctgtcatctccaatcccatccagagacaaccactattatcagttaagtgtttctccttcaatctctattctttgtgtggtgtgtatagattacatatatgtacagattacatatagagaaacaggagtgctgagagccgggtctcgctgagagtgtgtgcccgcaggttgacaggacttacgagtaactacagaaggtaagttttggactcaaatagacctggttttgaatcctgcttctttttgctagctatgtgattaaataatcatttcagtctctgagcctcagtctcatactctcataagaaaggctaggtgtgggggacatttctatacttattttcccaactgtatgtatgtatgtttgcataacttgtatgtatgtttccgtaacttgttttttcacacatcagaatgtctcagagattttccacattgttacacagaggagccacaatttcttttaatggctgcttagtatctaatactataaatgtgccataccttttaattgttgtcaggtagtgactttaaagttgtctccatttttttctctattcacaagcaatactacgatgaatattttcctataatccttctttgcccacatgcaggtattttttgaaggttgacaccaaggagtagaatctctaaatcatagctgcacatgtttgggttcaatagataccattgcatggccctcccaagaaaacagttcctattctcttcctaagtatctacaaatatgcatccgtgtgcacatgggaattcactttccaagagttcatggtaaaatggtcaagaggaagactgagaaatacaaagaatttcttctccccaggactgaaagtcctgttgagggacagcatagagagtaaggaagtgccacagagcatttaaactagatggaaagtatccaccattgactacaaactcactatagagatggagaaattgaggcctctcaaaaggaattgacttgccgagattcagctcccagtcccttcttgccaggcttactctcagcagttacaatgaagcatacccccttgtgtaggagccagaaggatagtttccaaattcaaacatgattatgtcccctcctgtgcttaaaatatttcagtagctaattgtgctccaacttcaagacaccacccagacttttttcactgttctccggacagacccaggatctcttcggcccagggcctttgcatatgcttttggtgctctctggactatttcttgctcctgcctctccacactctcacatcttgctaactcctactcattcttttaagagggagtgttcttgctatgtttcccaggctggtctcaaacttctggccttaagcgatcttcctgcctcagcctcccaagtagctgggattagaggtgcaagccactgtccccagcccctactcatttttgagatcccagatgaaacattccctctgcagggaagccaccttatcctccttgaacaaaccagagccctctcattatgtctcttatcatctcacacttctccttcagagcactgttcacaggttccatttacatttatgtgtggaatacagcaaattctcacttaacatcatcaataggccctcagaaactgtgacattaagcaaaatgacctactgcatgccataggaacttacttcttgtttatatcaattagcttatgggaaaatgattttgttatatagcacattctttgacttaaagtcacagtttctgagaacttatcaacaatgttaaatgaagacttatcatacttaaaaaatatgtgactcaccttctgagtctacaggctatatttctttctactgggtccccagcctttagcccagagtagatctcagtattatcttaatggatgaataaatgaaggagtagctttactcctcttcccttaccctgtgaccttgtggtctcactcctcacatctctccctgaggctttccctttgtcatcagagctgaggagacagccttgaaaagttcataccttcaggagacaaggcggctgtctgaaagtcactggggcttcagaatcagccatgcctgatttcaaagcccattcagccacttggattctgacatgtcacttttgtccactgagactgtttcctcatctgtaaaatggagcagcagcccctgtcttgcaggattgtgtaaggcatgagcacaggccctagcccagtcagctacctattgtgggtgttcaatgctggaggaagccccagagacacccccttctcatcatcaccatactgtgatctgaagcaggtttccatgcttatgataatacaatgttaacactccccatgtattcagatctttgccttgaatctaggaggtgagttcagctctagcatctgatggaaccaaccagtagccaccagatgcagatgctaagggccaacatgggatgagaaatggtatttccagatccctggaagaaaagttggtcataagaggagatggaggggtatttcctgagctccagcttcaggaatcagtaagggaggctgggggaacattctgcagcctttgcaaggggcacatatgtagtttcagagctgggaccatgatcaagaagtcaggaacaccccagaacttcatacactgctccttttgtttctttcttacccatggatgtggacctatgccttaaatcagcattgtttctggacttcatcatttgtcaagtattcactaatgccaggtccccgacaggtactagagattccctggtgggcaaggcagacatggcccctgccctcccaaagctgccaggccagtgtcttggccttagcagcagcaaggaaagggagctagagggctggtggcctgctttgccaggtctgggtaataggaggccttctcgacaaagaggtgctaagggatattccaggggagcaagaagtagcctgcagtctgatcttgacaaacaagcagccaacctgctatgggtcaggaggtgtctgctctctagccctcggcagggtcgtctggacagctctcagcctttcacccttctccagttaagggagcaaaagcagttagtctcctgaagtcaaaaattgtaattaatgaattaccatacaacagaactgttcttattttattttattttgacagggtctcactctgtcacccagcaggaatgtagtggcatgatcactgctcactgcagccttggcctcccaagctcaggcgatcttcccacctcagcctcccatgtagctgggaccacaagaacccactaccacatccatctaattttttgtatttttttgtagaggtgggttttctccatattgcccaggcttgtctcaaactcctggcctcaagcaatcctctcacctcagcctcccgaagtgctagaattgcaggtgtgagccaccattccccgtcttgttctgtttctatattgtgtccctaggatctagcacagtgactaccgtaagaaatacttggaggaaagaaaaaaagaaaggaggaagggaaaagagaaggagggagaaagggagggagggagagaaggagggagggaggagaaaggaagggaggaaagaagaaaggaagagaaagggaaggaagggaggaagagaggagaagcagggaggaaagaaggaggaaggaagggaaagaggaagggagggagggaggaggaaaggaagagagcgagggattctgtgaatgtcctacattcattcactcactgatttatttacccaactttcactggccacttctcatgtactagactatagagatatcaacaaagcaggggtagtccctgccatcatgagtctgcgttctggcgcctgcagggagagcacactgaaagcagcatctttttgtgcctcctgtagaacagcagccccaaaaaatgctgagccaaatgctccactgtcaaacaagcttgaatctgcgcgcccctgcttcccttcttggattgacacatcagaatatcaaagattctgagaagttttgcaataaaaaatgcataattaaccaggtctgttccaaactttttcagcctgaaacctgctttttctcagattgacatcccaggatcttaaaggaatcaggcgagatcgcctccctcttggcccagggtgtgagcctccctgtcctgttaggccaagtttctcctcacccagagcttattcccgacagcacgccctgtggaggggccctgccgccacaatttccgaagcctgggtttcttggcacctaagggactgctgccctgacagtgctccagcaaaccatgcctgtgccatcttgcccccacatgtgctggagtcatggagatacctcctgttgttctatccctgagacttgaggacaggaagaagcagcaggagaaaccacaaggggccggactctgattggaacagcaggagggctggaggcctggcctgacctgcaggcctgcacgatgatgccagagccccaggttttggcagagcctgaatcctgcttgccaagggaatttggaaactgccaaacccctgtgcagatgaagacaaatatcagcctcgtgtttctgattcacttaggctcagctcatcaaagtgctatttggtgaaagctgcttacatctcaacaagtcaaaggacctcctgtggaattgtgatttagctttgtccaaagatctcttggccacggcggaaggattcaagtcatgcctctcccacttcaggaagaactgtagccactagatatgctttgagaaatgtacttcacttttctgagcctcggtttcctcaattataaactgggaggtggtaccaacctggaagaattcctgtgaagattaaataattgaatgcattatttaaacccctaacacttcattagtgctgtataaaatggtgtatattattaataatagtattatgattattatcagcatctgcaccaccacctttatatgagtcagtgaatctgcagttattaagtctgaaatgttgcataggctattgagatagactgtcatagccatgacccacaatgacacccccttctcagaatccatgcccttctgtagtctcctccccaacagtgaccctagacttggacgtgtgacttgttttggccaatgagacatctgccctgagactgctttgcctataggaaggttagggtgacccatgccttggagagaggcccagaaatccccagccatcccagctgaatccaggtcccaactgaagagaaccatatgatgaacccagaggaaaccggcagaaaacccgcccagcctaataagttgctgtcctatgccactaagttttggggctgtattgtgcacagcgcaaatacctggtatgactatttagtttacagctggtccatcttcttacccattcatctcttcctttgctagtcacaggactttttcttgttcaactagactcctcagatgggagaaatgtagagcccggaggctggttggaagaaattatatgtttattatcttaattcgaatcagccaccaccccaggccacctcaaatagactcacagattacagatgaacctgcccctcaatgcaattagcacgcccttctcaggacagctggccacttagagccctgtggctgccattagaaccaaaatacaagtgaattcaaagtgattccagacactccatgaatacaggctacttactgggaaggaacaccagtctgaaaatctgaaagaggaaaagtgaaatgcattcgaaaaaaaaaactaactacagttttattgttccacaacacatactgtaactcacactaaacactgaaatgttaccaccaactggtccctgggtggctctgatgagtgaagtggcttggtttgcaattggcatattaattgtttgaatgcaaacaagttcctctaaagtatctgaagctgttcggtgaagagttgattctcttaaacacttcaatattaatactgcaaacatttaccctgtgggtgggagcaatgactcagggaaataaatctcacatctttgccttcagccaggtcttcctccaagacttcagatctatagtaaccacgtgtttatggaaagcagcccctggaatggatttaacagtgatagcttgcgtgtgccaatcgctgtgctaaccactactcatttaattctcaccaccactctatgagacaggcattgcttgtctccccactttacagaggaaggaaaggcagctcagaggggttaagtgactcgttcaaggttatgaagttgtgtgactccaagttccacactgtgacttcccccagccccactctgcctccccatcttgcctcctgtgtttcttttttcagtgcctatgtccattgtaggtccatccataggtccaagccacacaccttccaaaagacctcttgaaaatctctcaaacatggccactctctgcacccactgtgccatgattgccatcccagataatcacaatgtcccctaactggtctctctccctccatgttgtcttcctccaattcattctcttaaccacagctggagtctgtctaccccaagcctgagctccggagcttaaaccccacacggcagaaggagcagaattttccaaagatagtcaggagggtagctgggtgcaatgttggaaaaatggggatgtgtaggcagggacagaaaccgagggaggaaagcaaggttcagaaaggaagaggtgtctgtagagatcactttccatatgcaggaaaagcacaagagaaagtcgaggttaatcatctctccaatctttgttccttctctgcaataatttacctctgagattggcctgactctctaataaagaactttgaagtgtgcagaaaaaatccgcacacaaaaaccgtggtgaaaaaggccctgcagaatctggaccctacaggctagaggattcccagccagattcttacacatacaccctcctttaaaaacacctctatatccatataaaagtccccaaataccccatgctctcttccaccttggggcctttgcacaggcagtttccagaatccacagttctcttctttctcatgagtccctctactagccaattcctacttatctttcagactcccatttatacatcagttccttctaaaaatgttgcctgagcctcaggtcccaattaggtgccctcaaaaaatatcttccttgctaacttcccctcattaactgtcatttgttatacttgtttctattgatggtgatgctaataactattgataaatgaataaatgagtgatgtgtttgcaaccccagtttggacttgcccaatctgtgagcctgggtcaaagcggtgctatgggccccagggcatgccatgtcagaaacagacaaacctctgtctagggaaacatactctgcctcaaagttgagtaagaacttgtatctaaaaagaggcctttggcttcttgggctcagctgtggaacatgcttggaacacagcagtgaagggagacatgaagacagcataggaagaggcagaagtgagggaaataaggattaaccaggaccagggttaaccagaagtaagggttaacaagggaagccacttccattttcagtgggtgttcaaggcaggcagccttcggttcaaattttatgttctactgggtcgtgagaactatccatttttttgtttgttttttgtttttgtgtttgttttttgagatggagtctcactctgtcgcccaggctggagtgcatttgtgggacctcggctcaccgcaacctctgccttccagattcaagcaattctcctgcctcagcctcccaagtatctaggattacaggtgcctgccaccgtgcctggctaattttttgtatttttaatagagatggggtttcaccatgttagccaggctggtctcgaactcctgacctcaggtgatctgcagccctggccaaggactattcattgttattggtaaccagaggccttctttctattttgtgaacatgccaagttctcttccctgcctcatggcctttgcacctgcttttccctgcacctggaatgccctcccccaggtccttgcagggctggcgcctcgtcactcagatctcatttcaaacatcaccccctcagagatatcccctcagagatacatctcctcatgtatcccctcagagatacatctcctcatgtatcccctcagagatacatctcctaacccacctcctcacgttcccctcacccagtcattctctaccttacaaccctgcttgattttcttcatggcaccagccgatgtcttaagtaatcctatgtgtgtatttattctgtgcctctcccgctctaatgcaagattcgcaaagccaggactgtatctgcttgtttgctgctctatctcccatgcctggcacacaccaaaactcaataggtagttattgaatcaatgaataaatgattttaataaataaatgagtaaaagacgccagagtgaagtcccagcccttgggagcagaaggtaagaaaggtaaaagcagaaattaagtaacaatgcagggacccaaggcaacccagtgatctcactttggtagcaaaacccactccagagccaccagtgatttcctaatacacagtctgcccttcaaataggaggtgtcctgagcctgctgctaaacagagcagggcagtgtcttcagcctctgcaccaggggctcagaaataagcttctagtttgctggttctcaaactacctcaaggctccacccattccctcccttgcatccctcgcccagctccttcttcagcctgatgtgtccatctgcaccaatgacccagagggatgaaaaaacagcctgattttctttttttttttttttaattatactttaagttctagggtacatgtgcacaacgtgcaggtttgatacataggcatacatatgccatgttggtttgctacacccatcaactcatcatttacattaggtatttctcctaatgctatccctcccccaggcccccaccccctgacaggccccggtgtgtgatgttccccttcctgtgtccaagtgatctcattgttcaatttccacctatgagtgagagcatgcggtgtttggttttctgtccttgtgatagtttgctgagaatgatggtttccagcttcatccacatccctgcaaaggacatgaactcatccttttttatggctgcatagcattccatggtgtatatgtgccacattttcttaatccagtctatcattgatggacatttgggttggttccaagtctttgctattgtgaatagtgcctcaataaacatacgtgtgcatgtgcctttatagtagcatgatttataatcatttgggtatatacccagtaatgggattgctgggtcaaatggtaatgctagttctagatccttgaggaatcaccacaccgtcttccacaatggttgaaccaatttacactcccactaacagagtaaaagcgttcctatttctccacatcctctacagcatgtgttgtttcctgactttttaatgatttccattctaactggagtgagatggtatctcattgtggttttgatttgcatttctctgatgaccagtgatgatgagcattttttcatgtgtctgttggctgcatagatgacttcttttgagaagtgtctgttcatatcctttgcccactttttgatgggattgtttgtttttttccttaaatttgtttgagttctttgtagattctagatattagccctttgtcagatgggtagattgcaaaaattttctcccattctgtaggttgcctgttcactctgatggtagtttcttttgctgtgcagaagctctttagtttaattagatcccatttgtctattttggcttttgttgccattgcttttggtgttttagtcatgaagtacttgcccgtgcctatgtcctgaatggtattgcctaggttttcttctagggtttttatggttttagggctaatatttaagtctttaatccatcttgaattaatttttgtataagatgtaaggaagggatccagtttcagctttctatatatggctagccagttttcccagcaccacttattaaataaggaatcctttccccattgcttgtttttgtcaggtttgtcaaagatcagatggttgtagatgtgtggcattatttctgaggcctctgttctgttccattagtctatatatctgctttggtaccagtaccatgctgaaaaacagcctggttttctaagaaatgattgttaatcttgcatatcaactttggagaaacgacgtcccattcttcagcctcaaaggtaggagagtaatcacatgtcttcagaatgctgtgaaagggaaaccactgggcagctagaaaccacatggtgggtaggttgagtgtacaggcccttttttatacctgtgctcattgtggcactagtcacaataaccaaaaggtgaaagcaaacccgatgcccatccacagatgaacagataagtaaaatgtggcgtatacacagaatggaatattattcagcctaaaaaaaggagaaaattcttacgcatgctactacatggataaaacttaaggtcaaaatgctaggtgaaattagacagtcacaaaagtatccataccaaatgattccacttacatgaggttcctagagtagtcaagttcatagagacagaaactagaaaggtaattgccaggagttggtggggaaggagaataaagagtttttgtttaacaggtacaatgctttagttttgcaagatgaaaagagttctgaagatggatggtggtgatggccgcacaacagtgtgaatgcccttaatgccactgaactgtatacttagaaatggttacgatggcaaagtttattttatatggtcaagatgacaaattttatgttatgtgtattttaccacaattttttaaatgttttattattttaagttttgtggttttgttttctttaatgcaagctccggaatcagacacacctaggtttgactcctggttctactttttcgcttgtgatcttggacaaatttcctatctgctctatcagccaggatgcagtcagtccaaaatatggaaagcactccagacatccccagcagaaggaaatttaattcagaaaattgggtgcttataaaacgtttggaagagttggaggagaaaggatcagagtctgtccctagtgttcaggttttctggctgtgcttcagaaactcagcaatttcctcctgacgcagaagtcaggaggttccaggaagccactgctgaccctcacagctgccatactttcaggtcagggcaggtgacaagcagggctcacagcagttcacatgtctgccatcactgcttgaggagaaagaatggcttctgggcccctcttcttccaaatcttgcacaagtccatctcactggcaagaaaactgatcacatctagaactctagaggcaagggaatctcagcagaaggtggtttctgggcttctggtcactgagattcagggcagagcataggagatgagaataaaaagcagaccatcaaaaaatatgtcatgtatacctccctggccccaggttttctcatctcttccatgaggatattaataaccctcatttggagtgttattgggattaaatgaaataatgcatgaaaagagcttagcagagttctcagatatccctaagtctttcctgcctcaggtctgtcccatgttatcccctctaccaggaacactctcccttcaatgctggctacttctactcacactccttgtctcaggtgagctgtcatttccttagggattccttctaaattaaggctcactttgcattgtcactctgttacagtatttcaaagaatcttgtgcttttccttcatggcacttagaacaatttgcacttatgtaatttaagattatgtatttaagatctgttttctctcaactgtgaacttcccaaggtcagggacatcagggactcctccttcctattcttaggtggtcgcacctggcagaaacagcttcagttctggatgacagccctgcaaggccactcagccccagctctcacctctgcagctggaaagacagagatccagcaaggtgagggacatatttagagaaccataggccttgcatcacccacatcatgttcagccctggccagaggacagggagaggcagggagaggacaggaaggtgagtggcttcttgctggctggctcagagagtcctcctgctggctcctgccacagtccagagcaggcagagatccctcaccagcctctggctctcttctactgggctgcagtgcctgcacagcaggaatcctagcctggccacgctctggcctggactggtggattcagagcattggacttctcatgtgggaatgaccactttccagtttttatgcctgaagaaggggcagacaccaccagacactgaccccaccccacccctcataatcagaaggtgtgacttgagcttctcaaggcctcagttttcttatctttaaaatgggaatcataaaagccacttgaagtcaatgagaggagcaccagtcagaaacacatggcagagggctcaggaaatggtcccctcatctcacatcattctcctaccaaccccatccccatgggttaatgctctctcatccctcttaccccaagagcttccccctggcgcccatagaggcattcaggacctctcacctcaggaggcagctgaccctggccacccacccccagccaccacacagctcctgagtgtcagtcaacctcagcctattgatggcttcctacaatgtcccaggcctagacctatgaagtatgacccacactttcctgtaggcaactcccggagtccaaggaacttccctattcacaactcagagcagctccaggaccaaccaaagggaggagtctctgtttgatagacaaggctacatctcagacacactaagacacatgcctgaagggactcagctgcgtagtggagccagaacacctgttttctcttcttctcagctgcccttctactcatgagtctctgtgtaaccagcatatgatagcatagggagggagagagcaagtcagggaactgaggagcctcccaaaagaagcaacatgtatgaaattatgtactattgcttccttcctccctctgtccctctctcccttccttcttttctttctttctttcctctttccttcctttcctcctcccttccttccccttttccttccttcctttcccttttcctcccttccattctttttttcttctttccgtacctccttccctacttctcagtctgattgtctgtgcctccctctgcctacggacctgtaagcctgtctctctctgtcagtcagcatgtccctttccctcctgtgagctggctgatagtcagcctctggcccctggaagccatgtcaaatcccaaggaggggcaacgtctggtccaggccattatctgggtcataagaggccttgctctcagaaaatgatcatcccattttggaaggaaaccaggctttcacttgtatccagggcaaaacaggccagaagcctgagtctagaagcacccaaaacagacacacaccttctgcctaggcttccaggaccaatcagtgttggcaagacaagtgggatatcggcaggtcaggtgtgaccattcagaacagagcttcagtgaggtgtggctcaaggaaaagcagaagtgggtgctcagaccaaatggcatcactaatgccaattagggaaatgggcccattatcactatggagtcatcactatcacaggcatgcacccctggacacccaccaggatgcaaccattaaatgcccacccctccctgctcctcctactcttcccacacccgctggggatgagggctgttcctctgcctgtacatttactcaggtagagctctctgagacagagctctgtgcaacttgggaaagggctgccttgagaagtggtgttccccatcttgggagatattcaagagaggaatgaatttgtaagtctgggatagagaggattatcattgaacagtctttttaagctaagacttaagaatcctcaagaaggacactaatttttattacattatataatcacaattcccaccttaatgaagtgggcaccatgattcagacagactaaaaggtatagggatttgaggcacagggtttgaagtctcaaagtcatatcattgtgactccaaagatgcttgactttgttcttccaaacttcattcaaaagagacatatggctgcttggagtttaagagcccaagctcaggatccagaaatatcttgattagaatctaccattcatcacctgtgtatctttgaataagtcatgtcaccctgtcagcctcagattccatatggggaaaaaagcctgtctcatcatggtgaagaatacgtgaaattatgactatctggtccttagccagctttttggcacttagcaactgttcaataaatagtttgttgtatttgtgatacaatggcaaatccgagagtttggccccagagagaaatcaagagttaacaatggtgggtgacattccccatggccacatgacccagaaaatatgagtcttggcttaagcctaagtaggcattgccagagcctctgttcccaccctgcttttccatgacacaatgcaccttctctggtctcaatccccagtttctccactctgccctgggccagcaacccaggtctcccactctactctagacttgaaataaatcctttaaccattaagtacttaacatcatgttttctgccttcagaagtttctaaacagtaattaggcagtggaacaccctgccagggtggctagagtaaatatcattagtgtgggagggagtatggggtaagtggatgagcagggactcctagcacatggcagggactggctgacattggaatgaccaaagcctggtggagcagctccattgcccaacctccactgcttcaccctccctcttgggggaacctagctctgaagctataaggaccggtgatactatggagagagcactggctttagcatcagaaaaacctgactttaaaatccatccctgccatggtgaatatggacaaggtatctgaccactctatgctcatttcctcacctacaaaatggggaatatcctatcaacctcttagtgtactggtaagtattgaacgagatcatgcatgtgaagtatagagctactactctaatgggcccatgggggcatagattcaaaagtcacagtgtaaggtggcaatcatgtatacccaaaattcccctttaaaaatctctgtatcagtcaggatgggttgggttatgctgctatgacaagcaggcccaaagatttcagctgaaaccatgaaggtttctctctcattcagtgctgcatgtttctcatgcaggcaggtagagagactctgttagctacactcactcaggatccagggcctacaaagcagccatcagtggtcaccatgccagaaagaaagacagctctggagattcttgcactggcaattacaaacttcaaccctatagtggggcatatcatttctgctcacaacctactggttagaacctgattaaaacctgtcgcatggccccacttgagctaaaagttgttcagtcttctatgtccacagacagagaaaaggacagggagctggcgagtattatgaatcaccatcctaggatccctatgggagactcgcacacatttctcaatctgtccacaaggccagattgtctctctagcattggaacaaatcaccattgcttcccttaagcacttacagaataaaatagatgtatgcttcgggcaatgttgcatggaaatattaaaatccttaaccccagaatcacacctgatgcttcaaggcactcatacataaagaggcacgtgaatgcccagttggaagattcactttccccacaccacatgctctctctgtgcctaccctcactgaatagaataatggtcagaattatctctgtatttacatttttgtttcctctctttctttttgtttcaaagctgaaatgtgtaagttgaatgcctgtaagatagaaagccctatactaatacaactttctgggattcagctgcccctcatggcagaaagaaaagagttccctaaggctgtcctcattaagtccccagcctgagacccatccttctaaggcctctaatgtctctccttcagcacctatgacacgcctcattccttctctcctgttcttttccttctacaacacaactgcttcagagaaatttagtcccagcttcatcaaagtccataataaacacttaatgaaccagcctcctggtgagaggaccatttggctagtcacccagctgacaggacagaagataggcttgatgctcagagactcaaactttctgtggcatcccttagaatccaacttcccaggcccctggtcagctaaagtgctgtgtgtttcagaaccttggttctgaaggtcctttggagccaggagccagaacccagcttgaggtggagtaagtttcaggtagcttgaagcaggccaagtttctggctgtaaggtagtacaagtcatattttacaaatagtgacatatgtagtgtgtgtgtgcctcaatgtccttatctacaaaataatcataacaggtaccagacacagttgcttatccccctaagcaatgacttgagtcttacattggaagtcaaaattcaatggaagaaagtaaacatttattgagcacctactatgtgccaagcacatgacatggggtttgtatgtgttacttcataattttcacaactttcaaaggaaggcactcttttccattttacggatgaagaatctaaagctctgagaggtgcagtgactcattaaggccagtggtatttggagttgagtcctggtttcctgcctcaaaaggccatatgtcctcctctctgtgctcttgaatgcaccctgggaaagaagttattattgcctccacctagatttcaagccaagcaggcaggaacaatggattgagaaagagggcagtgctcccaggttggtctttggcgatcagagtctatgtgggaagtagccaggaaagctgggaaagtggataagcctcacccagttgcttgttctgagtccattggtctatgtcttcagaaaaaggcttccaagcctggacttgtaattaattacaggtgcaattaacctactgcgcacatagattgggtgccaaggcattgagtatccatgtgttctgtgcctgatgccttctttcatgaccaccttgacaaatgagtggacgctggtcaacaggcaaagctatttcccctgcctgttccaccctgaaatagcttgggcattcatcccttcttccctgtctccctgttcacaacaattcaggtctcacgtgcacaggcttttgcaacagtttcctgactgattttcgggctacaagcctctctctccgtcccacccaattttcccacaggccatctgagccatcttcttaaaatgcaaacctgatcccatcttatccaaattaaaaacaagcaaaaaaaaaatcctccgtagattccatgactctcgggatcaagtccagattcctacacattggcctcaaggccactcacactccagtggcttttaagttctccaatcttatctccctgctttcttcttcatgcacatccccagctctgttcacatctaattgccctctcatgtcttcttttttgcctccatacctttgacaaggtcctctttaccaggatggcccttctcccacttcttgtcttagagaaaccccatttaacattaacaagaaaaagaattactaaaatgtgagcattcaggatcttccttccctccccactccacttccttaggaggcagaaccagggctccagtcttcataaagataccatagaatgcagagactgagtcccctatttaacaaagagctgagacataggtaatatggggaagatatattttttaaaatacaagagagctgagcatcagagagtcttgtggcattaatagttgagattggaaaataggaggaacttcaggcgctcccacctagaggatactgagtgagggagctataagaagacagtatttataagagtagcccgtccccatttaacacttccttcagaaactgaatcaaagcttgaatcacttccaacaatcacatttgcctctttttactatctcttcggctacaccgaaatcagactgagccacatgggatatgtcaagaattatttaggttacacattctttagagtttaaattgaagctcttaaagcttgcctgaccaccttccctgacccagcagaattagtcactcctctctgtagccagagcacttcatacagacctttgttttaagtcttaacattgggatattttatttgactatatattttctctgtcatcagtccttgagatcctgagagatcagggatagctatgtcttcaccgtctctcaatgtccagtttccagaacaagtcttgacatagaaaaagtagcaattgattcttgttgaatatgcgactaaagagtaagctatcttgtgaagtcttcaccaagctgacccagcacctgggtctcactctggtcagaccaggacaggagactccactacagagaggtcagcctcactcctagatgccactgctttcagttttggtcctgaccacttccagttgagatggaaaacagaaatttgtttgttttaaagtgtctgaatatttagaaccacaaagaggagttgtccagtttgattctaaaaatgtgccttgtgcctcttcttcttctcattgcccaggttcaaccaggcctagcaaaaatttgctcaaccttcaccttgcctgggaaatggaattttagtagggactttgccacattcatgcatgcaggcaactgtgcgaggtctacaaagaaaataacttccaataccaagcacccttctagcagtcacacttcatgctatccctaagtttgggaagattttatcttatgaatctgtcttctcccacatgggcctctggctttgtccaagtgttggaaagaccacaaaaacacacttccccttcctttgctgaattgaggggctggtccctgggatagtgcgtgaagcccaaggtggcagcacaaagagctggaaatcaggcaatttctttcatccctcaatcctcagaggaatagacctcagctccctcttcaacctcaaatgatgccaaataaaaaggaaaagttggaaacgtacccacaggagaactcactccatagacagtatgagcctcctagagaaatagatgcccaggaagtttgaatgaatgcagtgagattgtgcattcctgaaggaaagagacaacaaaatcaccaccaaagggaggagatggaaatggccctccctttttctatgccagtctttccttcagagtgtctacttttccagggtctctccttctaccttatgagaacttgtgtataccctggaggaagagaacagaagggaagcttgaggctgttccttggttacactcagattgcactcaactagcccaagtaggactagttgaagcccagaattcgctgtgttcatgcgccagacaactatgaggttttgaccccaaattggacttcagcacttgatagtcaagtgactgtaggcattactccacctcccagagccacagcttctttaaaatatctatttcaatggcttgctctgggagggatgtgatgagatcatacatccaaaatgcctggcagatagtgagaccttggtaattgttagttgttgttgttgttgttactattactattaaaaacacaagcatgcttcattagggagactctgcaccacaccattcatataagggctagatgcccttatatgaatcttcatagcaccatgaacatcctcctttgtagctttccccacacctgtaattcctgctcaggatctgttgtcccatgagtggctcatagaccacattcatcttgttccccaccatctcgagtgtctagaatcacagtaaatgctcaaaaagtattttcaatttaatttattcccattctacccattcccacctcagcttctcttctctgaagttttttacctccctacccctgtccctcttggagtgtccagataatccttccatcttgttcatctctaccacctcccctgcagtggacccatagtccaatccagagctctgctcaatgtccttggagtctgagagggaaataacacagactctgcactgtgccctgaaatattcagaagaaaagcattgtctttctaattgccaggggatttttgtactggattctaagacttctggaattttttgccctcggatttggatactatcaaacaataaaggtgcaattttttgttaaagtttattgatggaattataaatttatatcaacgcagtacatgtgtaaacttgagaatctggagtgcttctacttgccatgctctgtgcattgtcttatttactcttgacattggttctgtgttgaggtcaacattattgttttgtctattttacagctgaaactcagagacgttaagtcatttgcccaaagatacccagtttgtaaatggcagtcctgggattggaagagactctgaatccacgtgccttttttttttttttttaagacagagtctcactctattgcccaggcttgagtgcagtggcatgatcgcagttcactgcagcctccacctcctatgtcgcagcctccacctcctatgtctcagcctccaaagtagctgggaccacaggcgtgcaccaccacaactgactaatttctgtatttttagtggagatagggtttggtttcaccatgttggccaggctaattgcttttcttttcctttaaagagacagttgcttttttaaaaaaaaatcttattttaggttcaggggtacatgggcaggtttgttatgtaggtaaacttggatcacaggagtctgatgtacagagattatttcatcacccaggtattaagcccagtacccaatagttatttttcctgctcctcttcctcctcccacactccaccctcaggcaggctccagggcctgttgttctcctctttgtatccatgtgttctcatcattcggttctcacttacaagtgagaacatgaagcatttggtcttctttcctgcattagtttgctaaggataaaggccttcagctccattcatgttccctcaaaggacatgatatcattcttttttatgactgtgtagaattccatggtatatacatatcacattttctttatccagttttctaatgataagcatttatgttgattccatgcctttgctattgtgaaaattgctgcaatgaacatacatgtgcatgtgtctttatggtagaacaatttgtattcctttgggtacatacccagtaatgggattgttgggttgaatggtagtttgggttttagctctttaaggaattgccacactgctttccacaatggttgaactaatttacactcccaccaacagtgtataagaggttttttttttctccattgatccacactcttaattccatgctgtactgtccccaaggataaatgagtcaatgtgtatcccaaaaaaaaaaaagaggaattggccctaaccacataccccatccctcctgaccaaaggaagttgagaggtgggcccgttgtctctctgccaatcctgaatctgaagaaggctgaactcttccagagtgtgcttgtcgaagtctacactcacacatgtcaacagatgacctgagtgagttagggtttagaagccagagatatcttgggcctttcttcttcagacccctaggtggctgttgggagaaggagcagggctagagtcaggtggacttctcaaaaagcttggatacacagaggggaagtaagtatagtgatgagatctgtgtaacactggccaacgcaaggtgggaagaaaggagcaggcatactacccagtcctcccaacaaccgtgagccaagtgtcattatccccattttaaagatgaagaaactgaagctcaggaagttgaagtcacttgcccagggcagttacagctccctgcacatggattgagatgtactggaaggaatgcatctgggtaggcgggtagctgagctcactgacaggcacccaccttcctaacttggccccagccctgtaaggcgcagggtgatttttgtaaacccagctggtgcaatattatctgacttagtctggtgatatcaagtgccaagctgaacaactcaaaaacccctccatctcttaatggaatctccttattctgaaatagcatattctacaatgacagcaaggtggggaaagaggacatgcacatggacagaagcctatctggctggtagcccccatcttgaacatcccaacgtcgagattggtttttacctgcatcagtggagaagggggagccaggtgtgtcctgggggctccaccttgagatcagacagaagccaaacacactctcacaactgaactctcccttcaccggccctcaaccacccccctgactaggccaccttcccctgctccactattcacttctgtttttctccctctccccagttctctccttctttcattcttggagcaagcagcatctgattatttacaaatatatttgagtatttagtatatgcacaagactgagaacatgaactagtggtctgactaccatatctggaccatagagatgttttatttacaacacatagagtgttttaagaaatcttgatgttttttcaacatgaagtattgtaggattttgtgtacaaagtcagatttctgccttctcttgaatgattgaaaagttggaagttctcagatgaacttttcacacagcagcaattggctgaggttgaattatatgtgggtcagaatattttccctgcatcctttttatcccccaaaattaaccttcttcactcatttggctactgggtatgtttaagactaagttgagtttaagactctcatctcaaaaattcccactatgcaggtgagaaaactgagacatcaagaacttggcaacttgcaaggtcactagtgggtggcatcccctgggtcttcctgataactgcccttctgcaatgcctgtgaaagtaaaggcatcttccttaacaggcctgttctctgcctcccatgatcttcacctgccaagcctggaggccaggaggagctagagaagacccaggatgacgcaggcaaaagacaaactcagatgcatggatatctggccttcatcacaaatcaggcctcctcccctgctgatggcttgcaggggtggagctgccgccaggcaggtgagaacagctctaagcatggcactgtccttacatgccctggaagggccaggccttccaggcagtggagcccctaaactggtagcacagactcctctacccaagatttactcacagccctactcctcaagggtgagagtctcccacgctggaggtgcacacacagaaaaaccccacacatacacacacacccatacagaaaaaccccatacagacacacacacacaaacatacaaacacacatacatatacacacgcacacatatatacatgtatgtgtatatacacatacaaacatgcatacacatatatacatgtatgtgtatatacacatatgcacaaaaaatacatatgcatgtacacatataatatacacacacatacaattaacacagatacacacatcgatatgcatacacacatgcatgcatatgtgaacacatatatacctacagacacttatacacacaaacacacacatacatacaacatatacacacaggcatccacataaacataaccacatatgcatatacatatacatgcacacaacatggactcacatacacatatacacacaatgctctgagagagtagcaagtgagcaggaggatggaaatgaaaggaggaaggaaaaaaggaaggaagggagggagaggagtgcgggatggaggaagatctttttaaattactctatggggagtacttgctctgtgccaggcattatgctgtgttttccatgctttatgttattcagtcctcacagcatccttttgaagtgggtatatttttatttttatttttccagtggagaagcagaggcttggagagattggacaactagccccagatctcataggccagatggttagcaacagagctgaggtatgagctgttgtctctgatagtgtgttcatagtcacaaaattcttcttaagtgccagattctaggccctgggaatacagaagtaagaaaatgtttccagtattcatggagttcccaattatgggaagtggggggaaatattatgcaaataatcacacacataatcatgcaattacaaaggtgataaatatgataaaattaaagtacaagacaccatgcatggttataacagagcagcccccacttaaacttaggggtgaaggaaagcctccctgtgggagtcacatttaagcatgtccccagcctattcgccccagctctggtcaaatgccttcccatcagcatactaccaggaaggaagagaaggcagagcccctatactgtcaaatcaggatgactacttcaataatcattttagagacaatctaccttatcctacaaaaagtcttgggaatccaagtgctttatgtacacatacatatatgcatgcatatgtaaacacatatacacctacggacacttatacacacaaacacacacacatacatacaacatatacacacaggcacccacatacacataactgtagtgaaagtctagggtcttgctgtaatgaaagtggcccattctgggacacctcacatctgaagcccccaccactgtgacttctgaagaaatttaggccagcaagaacattactgcttcagtgaacaagagtccactggattgtacgagactggtgttcaacagtgccaccatgtggacaggaccaaaacgatactctagtgaataggtgaagatttctagttctctcacctgacatttggaacagaatgggccccctttttactaaacaagacgccaagtggtccttggaaattttctctttacgctaataatgtaagtggggactcaagtaattggaaaaaataaaggagcagtgaccttagtgtcccttgagctgactaagtagttcctactggcttcaaatgagtctctagaatgttctgtggggctttccaaagacaatctgcatctttgttcaccttccagacctggagctcccacagatagctaacctccctcccaaataagctgctcacaaaattcctcaccagtctaatgaaaagaaaatgagtttgatgtcagataaacctgattttaaaccccagatcctgtacttactgggaggataaccataatcctcccatgtcctgtgctttaattttatcacacctatcacctttgtaatggtatgattatttgtgtgattatttgcatgatatttccccccttcccataattggaggatagtcaggatcctcacgctctacaagaattagatttcctcaaaaaaaaataacatctccttcacaggctgttgtgtaaggtgtattagtatcttagggttgccataacaaatcaccacaaactaagtggtttaaacagcagaaatttattctctaacagttctagagaacaagagtccaaaatcaagatgtcacagggccaatctctgaaagttctaggggagggtcattccatattttccttagtttctgatggttgctatcattccttggatctcccttgcctgtagctacaatgagatgacagtcaggcatgttgtacacagttggttaccttcagttgcatctgaatttacatttactgtgcccagttttgaagccttctgtatcattcaccagtcagtcaacagtaatcttatgaagtcataaatatatttgtcattcttctgcttacagtccactatggttccccggtgaaaaaatggttccccttaagaaaaaatattaatacatctttggaagagcccataagcccttcaccatctggcccagcctggtcttcccctactcctccacttgcctctacttcttctacattaacccactcattaatccatgcacactacacatatatttggactttcaggttttgccctctgccctattctttctatctctaatactccactcctttctccatcgagagtttttcttctcctccaggagtgcttcttctcatcattcaagactcagtttgcatcctattctctctaaggctttcccagatacccctggacagagttagactctcccacctgtgagtttctgaagaactctgtatataatgccaatatggtgctggtcatattctattctgatttccactgtgcctatgttctccaccagactgtgagctctttgaggacaaggacttggttttatccacccttactcctaggttcaccccaatttggaatggagtaggtgcttaataaacacttactgaaatggacatcaaacctgaataagttctgaggactcccaagtccctcagggctggagagaggaaccaccaaattccctctgatatctgggacatacacatagttcacaacaattaaaataactaaatctggatgactcaggacacctgagctttccctcctacattttccaccactttggcaaaccccttaacctctctaagcctcaatagcctcatttgtcactctgaagtaactcatgtgccggccagggctaggtatgtttagaaacgccatctgttttagccctcacaacaatcaaggtacatgagcacttgatttccactttatagatgagaaaaacggaggttcagagagattgagtaactttcccactttacacagctagtaagcagcagagctgggatcagaccaggcccctcaacccagagacattacttattcatttaccgctcctctcagaaaaatctttattgagcacccactgtattgttggcacagctctagatgctaggggtacagcagtgactaaggcaagtgattaaagtgtccccatatttatggcatttacactttccttctgtcatgcacccccccaaagctggtgacacaacatgagaggggcaacaggactgcagtggccccaataaggtccagcatacacagcagctttagaatgagagcagcaagactaaccagccaacgctaacccccaccacaggtggagatggagcctgatgtgaagccacgtcctgcttgctcaggacagggcaggttgaagttctttagcacctgtggttgggctgggccaggacagagaggggagaggcaacctggaagctgcaggtcacaagtctcctctcctgccactttgtgccccctccccagtcctgtcctcagccaagcacaggagcagtcgctcaagtttacgatgtgctgcgtgcaggttgcagacctaccatcatccataataggttgttgtttttactttccatttatagaggtggctgagttaccacctatggtcaccgcagccgttaaactgctccgggggctgagatttacatagcagccatgtgagctgccacaaacttggggttgggaggaggatgttttcaatcgaattagagctgatgattgatagacagggacagcagagaccagcctcatcaactccaaaaagcccaggaagccctcacccagaatgcactccctggagataacagtggtggagcccaggccatgcatgagataaagaaaaaggctcagaacaagtgggtgcacattcgcaccctggaatagctaggaagacctgggagtgggaattagaggatggacctctactcctttcccccatgatatcaaattcgcgtagtaattatgtcttttacctgaacagtggttcctaacaaccagctaataacgggatataatctccatagctttcaatcccaagatctcaaaacatattatgaataattaaatgccattatttagtgatttgggtaatcaaagacctttttaactgtcattttttttcttttgctgtgcccagaacacagctcagcaccatgttctcaaatgaggaaactgaggcacagagaggccaggtgaactggcacagatcatctgatacctcatcgtggctcttagtccccactccacactctttctccagggccttcagcactgtgcctctgcatgactgactgcccccttctccccagccccaaatcccacccccacctttacccatcctagacaccattatttaaatgtttcctgttgaaatcaccctcattcccactggggcaggtgcagggatccagcaggacaaattggccacctcccttcctggcctcaccttggcccctctcttaccatttaaatcctccaccctgaacaaagtagcaaaatgtaccccccttctcatgcggtttagtataaggacaggtttggatccctacaatgaaagttcatgtttctaacaagtgtccacagccagtgccctctgcatccatttaactgttgcctcctgaaagctatcattttctatttcctgtgactaatgtgcactgggagctaaattcacacgtgtgtgcaggaccctacttccaaagacatgtttcatcatcgtccattgacagggctctcaaccccaagccaggacccacgcatgccagaggctgtggcgagccacgagcattgcgtttactcatgcatgggcataaacctccatggcctctctcccctgcacagtctgagacacagggtggatacgcagtaattcaggctcctacagcgggcctcagactcacccctgccaggatacagatattgtagagagatttttttattgtctatctccctcatcagcctgagctctctatctccagatctttcctgtagttccttaatattctgaacaatactatgtggcagatatggtttattccattttacagatgtggaaactgaggttaaatgtttactcaaaattacacagagactaaatgccttaatcataataggactcaagtctctttggtccccaagtttcatgttcttctcacaatcccccagttaatatatctagtccaaataaagaacagattaactgactaatttaaactcccaaactcacttctgcaccagtgctctggaggatcaaggccatatccacagagtacagagcaaaaaaggagaactagcaaatacccagagcatttggcaagtatcttagacattcaagccagaagatttaggagtgaaagagaattcttattatcataattgttatcataattgccaaaacaaataaaattaaccaaggacatgtagctgtatctgcacccaagcaagactgtagcagttcttaaccaatcaacatgtctattagcatgaagcaattgtgtcttgcctgtgatcggcacctcatttttattcatcaaatatttattgggtaccagtgatgtgccaagccctgtgctggaactcgagatgacacagatgactgacgtggtccccgcccttgggaagcatgcagtccaggaaagtcatagaatgcagctcccaagaagaagccactggagcaagcagatgaaggttgggaaatcatgcaagcctagggcagaccagccaaactgcaatgggaatgcagctagctactcactctgaggccctaaagcggaataaaagggactgcaacagcttagatttcccctttccctcctcagggacaggagtagccaccattcaaatctttctgtgatgactagctgtcttagtcagctaaggctgctataacaaatcatcattgactggatgatttaaacaaaaacatttatatctcacagttctggaaactgggaagttcaagatcaaggcactggtagatctggtgtttgataagggcagtctcctggtttgcagatggttgtcctctagttgtgtcttcatatggctagagcactctcaagtcttcttataggcactaatcacacctcccaaaggccccacctcttaatagaatgacactgggggctagacttcaacatatgatatttgggaggacgcaaactttcagcccatagcatgagcagtcttcatgcacaggaggctaatcatgatacttcatgtgcctgccatttgagcctcacatctctcctccatgccagagtgggtcactttatgctaccttattcatccctgatgctctcccttagttgaacagaatccccttcccacccaaggaatacgcattgccctgtcaaacaagggaggctttctcacttagggcaaagtataacagcatcctagctaggatttgggggactcaggcatggatcatttggaggctagatgggctgacagccaactggtaccagacactgtcacttcccattaacagcccaggcatctgggagcttgcccacctcagggcaagtccattgatttattttttaatctacagaaacctgaatctaaaagattggcagtaacatgtgatgcccatattcaggaattttagttttggtgcactgggggcccctgcttgccttttggtcctagaaggcatctcaagggctcatgcaaattaagttccttacagccaccccagagatgccagggtgccccagatgggcacaccagtgacaccatgccatctgatgcttggaccctcccagacaactgctttgctagcgaataattcactggattcagccattgagacactggggaaacatagctgagatgaagttggcagtggagacagttacctagctccttcaagggggaaaagcacatactacccttctttcattaaccagtcagataatgtatctgcagggtgttatcagtcatcagcaccctgttgcaatggcaattaagaggattagaaatcagcttccattttattgcagttcccatggaatgcatgggtagagaccaaagagcagagcaatgcatggctgtcagcaatgcagggtcattagtgaggcttgggaaagacaataaatccccagataagtcaatctttcgacaacaattattgataactagaagttacatcagacgctgtgttgggctttagggaaacaggtgaggccaacactttgcctttccttgaggagttcacatcaagtgcgagacaatgcagtcaagttagcaaattattatagaaaggggcacaaaaaactcagtgagcaaagaactctgaaggcacagaagagaggactgcagattctacctgcgaaatctgaaaggcttcagagaagagttgtcatttgagatggacattgagggtaagtagaagatcattggataaatgaggacagacccttcagagcagcagcacaacgtaatgctcaaagtcatggactatggagtcagacttgtgagattataggttaggccagggactaacctggtgaccaagacaagttactctaatgactctgtaactcagtttccacatgtgaaaaaatgcaattgttctcattattaaattagacaatctatgtcaaagcacagggcacagttcttgggaactggcaagggccaagaaatgtcagctattatcatgatgtgcagaaggaaaggtttgaagtggatgagaaaaccactgtggcttagagctttggtacaaaatgaatagtagtaactgttcaacttaagattttggtatttatcccataatcaatggagaatgccaagcggtttctgacctgaagtatgccacactgagttggggtagagaccatgggcctggatatattgacaccagggaggagccactgacttggggcttgacttcgggtggtataaatgagggcagagagaagggaagggatcctgaagatattagcagggagcttcaactggttttgctgactgtgatggtcggttttatgtgtcaacttggttaggctacagcctccagttttttaatcaaacactaacctaggacttgctgtgaatgtattttgtgactgtgattaaaatccttaatcagttggttttaagtatgggagattatcctacataatttgagtgggtctgattcagttgaaagaccttaagagcagggctgaggctcctctgcagtaaaagaaactctgcctgtggacagcagcttgagccaaaagctccagcctgcccttcctaccagcctattctatggattttggactttcctggccaatcccccacatcgcaaaagccaattctttgcaataaatctgaatacatatctcctactagttctgtgtctctggttgaacccagatttacacaataacggattggataaaggaaatgcgatctgtccataaaatggaatattatccagacttttaacaaagaaggaaagcctaccatttgtgataatatggataaacctggaaggcataatgttaagtgagccagtcacaggacagatactgcgtgatttcacctatatgaagtagctaaaatagtcaaactcatagaagcagagaatagaatggtgggtgccaggggctggggggaagagagtaataagggagattttgcttaatgggcataaagtttcagttatactaaatgatacactttagagatctgctgtacaacactgtgtctatagttaacagtatgatattgtgcagctaaaaatttgtataaagggcgtatctcattttaagtgctcttatcacaaaaaaaggaggtacaaaaggaaatttttgaaggtaatagataggtttgttactttgaccatggtgatattatcatgggtgtatgcatatgtccaaactattaaattgtatacattaaatctgtgtatttttaatatcaattatacttcaataaagctgtttaaaaaaatgtagagctaaaagaagccacatcagttcctagagattcctcacaaagccttggacatacgattggttcctgcctcatccttgtgccaaagtctataaaaatctctcttttatgtggctgccttttctggacaaggcaacattcctgtctcagttggcagctctatagagcagattgcagaagtttggacatattgactctgacatatggatcatgctctcaggttggtttttgttttgttttgttcctaatatatatcgttttataaggtttcttttatgttaggctgagtctttgatctccccagaaaaaaactctgcctccccccagagtttcttttaatctacaaaaatcactgaccacagctgcagacagggaagggttctgcaaagagacaagccaagtacagtgagagaacatagactcagagagaggtaactaggaagcacagtgcgtttctccaaggcccctgacattcgtgtgacgtgctctttgcagtcatccaagccctgagttccagaatgcatggctaacaaatgggaaggggagagccagctctgtgccagtcttgtctcaaatattagctattctcattcttgcatcagtctggtgaggtaaagaccctgatctcttataacaattgaggaaactgaggctcagggagtgtcttagcttggctcccccagaagcagatggtgaggcaaaggttccttctactttgatgtaatttcaaatttaaagaaaagttgcaataacagcataaagagttccaaaatactctttatccagattggctaattgttacattttctcctatttgctttgttattctccttcttctccccgcctcccatggttttttaatgaattatttgaaagtaatttagagacctgatacacctttgcccctaaatatttcagtgtttatgtcctaggaataaggacgttgttgttgttgttgttttgagacagggtctggctctgttgcccaggctggagtgcagtggcacgatcttggctcactgtagcctccagcacccagactaaagtgatcctcccacctcaacctcccaagtagctggggctataggcatgagccaccacgcccagctaattttttaatattttttgtagagacaaagtttccacaaaaatattgcccaggctggtctcaaaactcctgagctcaaatggtccacccaccttggcctcccaaagtgctgggattacaggcatgagccaccatgcctagtcaggacattctttttttttttttttaacttttattttagtttcaggtacatgtgcaggtttgttatataggtaaactcttgtcacgggggtttgatgtacggattattttgtcacccaataactattgggtgatgaaaaagttaactgttaggtactagttaactatcatgtactaagcctaatacccaatagttcttttttctgctcctctctctcctcataccctccctctctgttagaccccactgtctgttgttcccctcttcgtgtccatgtactctcatcacttagctcccacttataagtaagaacatttgatatttggctttctgttcctgcatcactttcaatgccaccatggtacaattatgtaccatgaatcatgaaatgtaacactgtcacaatactactatctgcacaggccacactcagatttcatcaattgtcccagtaatgtcttttataaactatttatttttccttgttcaagatccagtccagaaccagggattacatttaattatcatgtctctttagcctcctttaagctaaaatatttcctcagcctttctttgcctttcttgaccttaacatttttgaagagtattggctgggaattgtgtagaatgtccatcaattttggtttcactgagacaaagattttttgaaagcactcctcaggaagtagaaccacagaaggaaaatggtcagcaaagttgtactatcaagcaaagtcccacagcaggcgagtctggctcggtcccacagggaagctctgcaaacagtatgggtcacacctcagagctgtccaatttagggacaatggagctggagaatgtttgacccctgcacccagcaattgccttcagctccagctctcatgcacagtgcctaaggggctcctgcagccagaaggcacacatgctggcccattggctggtgagtacaaactgtgaagggatctgggggaataaagctggggcactggcagtatgtgctacaaagagttttacttacccagaatcacacagtttgcaagtgacagagatggaattccagcaagctccgtgtcatttatctatattccatcgcctccctgaagaactaatatcaaccagaagcctggataatcctatgtcccagagaaacaatgcgtcaggcatcattttgccatagaaatgtgatttttttttttaagtttttaagcagaatcccattgtctgcattttggagtgtggttggtttttattttcttgactttttccattattataaaatgtcatgcaatgagtttatatgtgtgtcataattaataagagaaatgaccaaaatgcagaacactcggttccccaggatacatgactgcggctggacagcacagcatctgagagcctgggctctggctccagtctccctggactcctgtgcagtcgccaacatgtcacctgcctctcagaatatccacttagcatctgtaaagggtagtaacaccaccaactaggaggttagcggagagttaaatgagatgaggtgtgtataactccgttaacgcagtacctagtgcatggtgcgtgcaatggtcggaatgtttatgtccccccaaaattcatatgttaaaatcctaaggcttaaatggtgctattaggaggtgaggcctttggggaataattagcttatgagggagtatccctcatgtatgagaatagtgcccttataaatgaagcctgagggagcttgatcgccccttccaccatatgaggtcacagtgagaaggcaccatctgtgagcaaggaagcaggccctcaccagacaatgaatctgctagcatcttgatcttgaaattcccaacccttagaactgtgagaaacaagtttctgttgttggtgacccacccaatctatggtattttgttatagccacccaaatatgctaagacagtgtgccctctgtaaatgttaactgtgttattaatacccttgatttaggccgggtgcagtggctcgtgcctgtaatcccagcactttgagaggctgaggcaggcagatcacttgagtccatgagttcaagaccagcctggtcagcatggcaaaaccccatctctactaaaaatacaaaaattaactggatgtggtggtgcacacctgtagtcccagctactcaggaggctgaagcaggagaattgcttgaacccagaggcagaggttgcagtgagccaagattgctccactgcactccagcctgggtgacagagtgagactctgtctcaaaaaaaaaaaaaaaaaaaaatacccttgatttacccagagggtgtggtgggtctgccctgcctgcatctgattcacctttgtccctacccaccttttaatctcctctgctcagcacaggccagcctggcagtcagtggttgaagtatttgatgaggaggttgataagaacaaagaatatccatctgtgggctggtggagacaatactggggtgagagaaagtagccatgaggatagaacccataagacaaagtcctaagagcttaggggtgaaactgcaggctggctccacctgagacaccacttcctgctcagtctttattcttttgaagaagagtccgcccagtcactgaaggccatgagaaaacacaaaaacatgtgcagatcctccttccacatgtcactcccctcctcaaaacctctcagcagttcccccattgtccttgggctaaagaaaaaatcctatcaagggtcttcaaggctcttcatggactagtcctcacctcctttccagtgccatctgctgtcacctccacctacaatcaccacccaacacattgccctctgaaatgttccgcctgagtcacttgtcttttcccaaatacaccttacaggttcactccttcatgcctttacacaatgttgcttcttttttctgtaagaagcatccctgtggagggcagattctaaggtagctcccagtgatcctaccttctgatattcttgccattgcttaattcccccctttgagtctggaatggacctaataactctcctctaagttactggaagagaaaaacgatgggatgtcacctctgaaattaggtaacaaagactcttgtttgtcttattcatcctttcttggttgcttgttctgatggaagccagctcccatgttgttaagggccccacatagcaaggaactgagagaagcctttggctagcaaccagtgagtagctggggccctcagtccagcagcccatgagaaattgaattctgccctcagatgaaacctcaggacctcattagccctcagatgaaacctcaggaccagtcaacatcctgattgcagccttaggggagaccctgagcctgaggacttaatttatccatgccctgatttttgacccacaaaactgttagataatgaatgttttggttttaaaattctacgtttgagagaaatttgatgcacagcaatagagaactaatacatatacctttcaacctgtcaaagtcatactcacttactccagtattacttgtcctaggaagtcttctctggcttcctgcccttcaccttggctgagttggtcagccctcctgagtggtgccatcatgccctgtatttccccatcacagctccagacatggtaccacaatttcataataacttgtcagcctctccctctggaatgtgagtcctttggaaccagggcttgtggcttattcacctccataaccccaaacaagcccagtacctgacacctaataataataccaaacatttattgagcgctcactgtatgcccagctaaattttcttttcaaactttatctcactgaagcctccaattaagcatcattaaacccactttactgatgacaaaattgaggctcagaaagattacacaagctaatatgtggcagaagtggaactttaacccaggcagcatggctccaaagttctagctctgtgtagtaagcacttgttgaatggctacccaactgaggatgtgctatgtggccacaggattgaccacagacccgatatgactgggcatctatgtatctgccccacagaggagtgagagccccacaaagtttcagagataagttaggagccagtgagcttctaacttaggagctatttccattcttgactttggaacagctgggttgggatttcccggaaagcctgagccagaggccaagactgaagccagggagcaaagttaagtggccaagtcaggggccaattagccatggtgagctccccagggattagagtccctgagccaggtgaggacaaagccagggcttgagggtagaagacaaccatctgggagacccaggtctctgaaagctcataaatatgtattcatccatccaaccaattccactgttaagacgcaagtcctgatgtttattgagcatgtactatatgtcgggtactgtctagggctgggatagaacagtaaacatgtcagacaaaaatttttttgtccttgtgactttacattgtcatggggatagagagacaggaagacaattaaaatgaataaggatattataagatagaaggtttttaagtactatgcagaaataaatcaaaaaaggaggagaagggggagccagggtgtaagaagtgtggatgcatttagtagaattatctcatgtggaaaatgttaagaacttagcctgacgtgtagtatccatgtaacaaatgttaatgttatgactcctactctgagaacaagggtggggaggtgttgtaatttgtcctaaagctagctcagtgagttttaagggggatacctctgtctttagtgtcaggattcattgagtcaagctcatgaacattaacatgtgttggttccagtggaagacagatttctaagcaatgtgggagactctgctgggatatggacaaccataaaacccaaggtcttctctgtgagtacaaggatgagggagcaggtgaatataaagtttacagtaccacctgaataaatcagctggacacaaaccagcagctaggactacatatgatggcacacccagaccttgggctctaatccatcaggcagttcaagggaccagaggcagaagctgagatggaaagatgggcgaacaggctatgttgaggaaggtcaagatcttcccatggcctcactcagtgctcatccatggttcagggcctgccctgagcagtacaagtaactctagccccgatgcaggctcatctgagaccttgacagctgctggtctgatccaaacagatatctggggaagtagggctcagcttgcagctgatgttgccagtccaactcctgaattctccaaatcacactctgcaacatgcatcacctagcactcttaggctgagattttgtatcatgaccacatttagagcctaacctcacccttccccggcctagatctattcaaacatcctagccaacctctctgaactcctaggtatgagcccagaggcacccaaggcatgccaggtttgtcttagaagtacttgatggcttttttcactcctgccccttcctgccctcagcagtctcctggggtgacttctaataaacacctattaggtgccagacaccatgatcatgtagtcctcagagcaccgctacaaaggatctacattatccatttcatgagatgagacaactggagctgcaagacagtatgtatactaaggaaggaagcatgcacacaggatttcgacccaggtccgtgtgattccagcccatgcttcttccataaaaccatgcagcctccagcccacatttttcatccataaaatgggttcaaaatgagaacacatggacacaggaagggaaacatcacactccggggactgttgtggggtggggggaggggggagggatagcatttggagatatacctaatgctaaatgacgagttaatgggtgcagcacaccaacatggcacatgtatacatgtgtaacaaacctgcacattgtgcacatgtaccctaaaacttaaagtacaataataataaaataaattaaaataaaataaaaaatgggttcaatagagcctacctcatacagctactgtgaaatttccataagaaactacaaaaccttcagcacaggacctaataagggcctgagagaaatgacatcatctttcagccttcctgagacatcctgctcattgctttgagaaaataacagggtaggaaggaaatgggtatccttggaaatacttagctctttcttctcaagagaggaagctactccccagctcctgggcactcataactctaaccaggaaagtgctcatttggtgagaatcagggccacacacaagccaggagcatctgctcaagtattaaaagtgagcctgtacggtcctgctattaaactccctgtgggtgagctgggttaacggtggggcctcatgtgataagtcattaatctctacatgtaatgcaagagctgtacaacttacttcagccttaatctcccatgagttacagcttcttctgtgattcataaaacaaatcaatcacacctcccaggctctcatctatttattactgctttttaagtgcttggagagggagaaactggtggatgtttttaatcccctccacatctaggcagacctccacaggctgcaggaaaatggactctatgccccaactcaggtcacagactaagattagtcgaactctgaagcttgcaaggagcagacaactttgcatctatagcagctggaagatacctccctattgctcagaaaaggaactgggatcaggtttggtcatcgccagcctgcatcaggaaggcttgttagtgtggtgggtttaaacacaaccacacacttcttgacacttctctctttgagagttaggatctctgtctgccctccttggaatctgagtggtcttgtgactgcttcagtaggatgtggcagacatgatgctatgtgacttccaaggtttgtcataaaagaccacaaagtttccatcttattctctgggacactgtgctgccacataaggagtcacaccagaatagaaacatgtagtcccagctgagtccagcttccagccattcctgccaagatgccagatgcatggaatcagattctccaatctcctaccattcaagtcacctccaaattttttagttttcccaactgaggcctcagacaagctttaatgcagagtcgagcaatccttactgtaccctctctaaattcccaacctacagaaactgtgggcatatttaaatggttgttttctgtatcattaattttgaggtagtttgttacacagcgataggaactgtaaccatcagcaaggaagcacagcagtagtagcatagtagtaacaaaagggaaagtactcactgcatgcctactctctgtcagtcactttgcatattttagtattgcaatcagtctttaccaaattcctacaaagtgggtgctattgtccgtactttacagaagagggaatgatggttctgaaagaataggttacctacctcaggccacacagcaaagatggtatccacagccctggctatagatccaaactgctacttgttcctctggccacactgactaccaaacagctttgcctgaattctctacatatttcaactattttgcctaaacttttccaaagtcattcaggtatttggctttaattacctcaatatttcaactatttttcctgacttcgttggtgtcttagtaatttttacctaaatctctgctgagattattccactggtggtgggtgtggtgaggttgtgggggtcttagcttcttgaccacaccaggagctggacaggagtggacactccacagcaagccccaaaacttgaggcctcaggcatgggcctggcagtgggaaggatctagattgtaagtcctcctgggccactcatgtccatgggacactgtccacagaagcagtatgaggccaggagagtgcaagcttgactgcctgaactccctcttggcctcgtgagccttgcagagtgcagctcctgccttcttcttgcaaacaatgtcagccttccagacacaagctatggcctggtgagtttcatctcctagtcttcccacaaggaagctgcttaaacacaattctgcaagatcatggtcccgcttcatagccgtatggcatacaaccccttcaagtagtagccctgggaggtgacctcaggtggacagcatgtggctactcaaaattcattcgaagtagaagtggagacagcaaggcatgagtgtggaaagacaagacaaagatggtgctaactccaaccattaagtgatactgtaggcctccctcagctaagaacttaaactcccactccaggttcccaccatccatctaccctccagccaggaggatcttttaagataaatgaatcagatcacagttcgctcttcatttaaaaccttctaacagtgttctgccacacaatggccaaaaatccaaactctataccatagtctagcagagatgctcaaacttagcatgcatcagaatgacctgtggggtttactaaaacacagattgctgggcctcacctcctgagtatccgatttagcagatcatgggtggggctcaagcatgtgtattctaacaagctcccagtggatgctgatgcccctgagaaccactggcccatagaacccagcatattttgactcctgttggcctcttcagcctcactctttcctaacctaactctcattcacatataccaagccacaaagaccctcactgggatccataaactcacctgactgtttcttgctttcaggaccttagtgctcaggagggccctctatgtgtcccactagtccccagtcctgaaaaccttctcattctccagggttctggctgatgccatctcctaaaacagcccttccctctcctcacccacgaaggataacctcaccctggtacctttattcactgcttcccttctgtttgcttcttagcaagcctcaatgtgcaatgggaattataactctttatttattggggtatctctttgtatatttgtgagagctttctcctgccactttagactataggttccttccaaccagattctgtcttaatcaccacggtaatcccagcaccccactccatgactgtcaaatggtgggtgctcagaaaatgtatgttaaattggtacattgccttaattcattctcgttacaaccctgggagaaaggaattgttaagcccattttacagatgaggaaacagtttcaaagagggaagtcccatgctcaaggtcaaacagtcaggcattgaacctaggtctgtggactccaaaggtcttaacccactctgtgtccattgggggacaaacaaaggagcagggctattgaggaaaaatggtatggatgagatactggagaacagaaatgaggcaagcaagcagcaaggaggcaggcagaaaggtcagctggcataaggacttgggcaccctccagacaccccagtgccctgaggggacaaagaaacaaatgagggtgttcacccagctccacatggagtccaggcagctgctgcctgaagcactgtggggttgccgcaattccacctttaggtgtgaaggcttttgcttttccacccccatcccctccatcagactttcctcttctggtgtctcattggtctggacagtaggtggagcagaccatggacattgggaaggggcagggttcagggcaaaggcagggcataaatgggggaaaggagaagagctgaaccagactgggaacagggacacaagaggacaccactgccagctacatctgcttccaagagctgagattccacagccaaaggtcttaaactccatgatatgaatttcccttcctgttgtgcaatgaccaccctggcattgcaccagagggctgcggtccaggggtcaggcccctttaggactgtaccctggcctcatgctcatggccatgtgttctctgggcagcagtgctgagcctggaaggagggaacctcctactggagacacctgtagggcactaaggagaaagggagagaaggaggtatggcctcagcttctgcctccacagcccaagcgtcagcccgcaaagaagcaggaatggggtacaaggctgtgagcttcagggcaaagaaggcctcccacagggtgctgctcagagacagaggtggacatctgcagaagatatgcacaaataatcgcccagcacctcagaaggtagatactcccaggaggcaatgcgcctctccccaaaagtggcatagaaacctctttctccttctatatcccaactcaaaagctcactaacaagggctaagggcctctagcttaaaggcaaagaggacatttgaaaagactttgctcctcgtgtgtgtgtgtgtgtgtgtgtgtgtgtgtgtgtgtgtgtacatgtcaaggtgtacctgtgtgtttgtgcatattcaaaaaaatgggaggaggaagaagtagagggtggatgacagaaaaaaagtgtgtaacccagttaatgtaggtctagaatccaacagtggtcagtaaggggaaaagaccagtccaaatcattaatcaatccaccaatagttatttaactttattacacgccaagcactactttgaacacttgggacacaagagaaaatggcacaaacattaagccctgatttcatgaagcttatgatgtagtgagaaatacagccaatacatttatatactgttgagtataataagacagataaaaataagggatggagcactgtgggaataaacaccagaggactctaggaagggaggcctcccagaggaagcaatatttaagagaacaactgaagggtgcgtagaaattagctaggtaaagtggcaggaatgcaggacagaagggccaaagtctttctgatgtagagcaaagagcaagacagaacatgagacagactgagatagagccaagacaaattagaaagaatctcaaagaaataaaagtagtaataattactttaaagcacacactcaaactagtttaacaaaatgttgttttaattatatctaccttaatgaacagataaaaacagtttgtaattagttctgtaattggttatgtgaaaagagatgcatcttcaagttctaaagcatatgtcccgtagacaatttatgagaaaaaaaagatgcttcttcaagtactaaagtatgttgccctaaagagctgtcacattccagtgtcttgtagacatatttttttcatgggttctgcaaaagtagactgtatcttagtcatgcctggatcagaaacaaaaagaattaaaaagagcttttactctagatgtaagtgactctacatagagctgaacagactgacagatctgggttcaaatcccacttctgtcactcacaagttctgtgaccttgggcaatttcctgaacctctctaaggctcgatctttaaaatggggatgaagataatgctattgcataaagttgttatgaaaactaagcaaggccacacacacaaagcacacagcagagtgcacagcatctatttgcatttaataaacatcaactgttatgtggacccatgcatgttatgttaattggctactgttggcatgacaaactactatgaatttaggagcttaaacaatgcatattgattggaggaaccaagatggcccattagaaacagctccggtctgtggctgtcactgagaagaatgaaaatggtgagtgaatcccgctccatcaactgaggtatccaggttctctcactgggaatgattaggatgttggcatgacccacacagagcaaggaaaagctagtgtttcctgactgctggctgtctggatgagggggattcttcccagtgcagccaaacctgctcagccaaggggcagccagactgcttatttgagcaggtctctgattccatgcctcctgactgggtgagacttcccaacaggggttgccagacacctcatacaggagctttcttgcctgcatcagctcagtgcccctctgggacagagctcccagaggaaggagcaggcagccatctttgctgttctgcagcctccactagtgatacctccaggtgcaagagggacccaggagaattgggtctggaatggttcccctgtaaactgcagcagccctacagaagagggggttgtttgttagaaaaacaatcaaacaaagcaacaacaaggacaacatcaacaaaaaagaccccacaaaaaccccatccaaacataaccagtctcaaagattgaaggtagataaacccacaaagatgagaaagaatcagtgcaaaaggctgagaactcaaaaagctagagcacttttttttcttcaaatgattgcaacatctctccagcaagggcacagaactgggctgaggctgagatggatgaattgacagaagtcggcttcagaaggtgggtaatagtgaactttgttgagctaaaggagtatgttttaacccaaggcaaagaagctaagaaccatgataaaacattacaggagctgttaaccaaaataaccagtttagagaggaacataaatgacctgatggagctggaaaacacaacctgagaacttcacaaggcaatcacaagtatcaatagccaaatagaccaaggggaggaaaggatctcagagcctgaagactatcttgctgaaataagacaggcagacaaggttagagaaaaaagaatgaaaaggaacaaacaaaaccttcaagaactgtggtatcatgtaaaaagactgaagctacaactgattggggtacctaaaagagactgggagaacagaaccgagtcagaaaacatacttcattatatcatccaggagaacttccccaacctaacaagacaggccaacattcaaaatcaggaaatccagagaactccagtaagatgctccatgagaagatcaaccccaagatacataatcagattctccaaggtcaaaatgaaggaaaaaatgttaaaggcagccagagaaaagggtcaggtcacctacaaagggaagcccatcagactaacagcagacctctcagtggaaaccctacaagccagaagagattgggggccaatattcaacattcttaaaagaatttccaacccagaatttcatatccggccaaactaagcttcataagtgaggaagaaataaaatccttttcagacaagcaaatactgacagaatttgtcaccaccaggcctgccttgcaagaccttctgaaggaaacactaaatactagccactatcaaaacccactgaagtacacagaccaatgacactatgaagcaactacattaacaagtctgcaaaataaccagccaggatcatgatgacatggtcaaattcacacataacaatattaaccttaaacataaatgggttaaatgcccccaattaaaacacgtagaatggccaactggataaaatgacaagacccaccagtgtgctgtatttaagagacacttctcatgtgcaaagacacacataggcttaaaataatgggatgaaggaaaatttgccaagcaaatggaaagcagaaaaaagcaggggttgccgtcctgttttctgacaaaacagactttaaatcaacaaagaccaaaaaagacaaagaagggcattacataatggtaaaggattcaatttaacaagcatagctaactatcctaaatatatatgcacccaatacaggagcacccagtttcataaaacaagttcttagagacctacaaagagacttagactcccatacaatactagtgggagactttaacaccccactaccaatattagatagattattgagacagaaaattaacaaagatcttcaggacttgaactcagctctggatctagtggacctgatatatatctacagaactcttcacccaaaaataatagactatacattcttctcagtgccacatggcactaaattgatcacataattggaggtaaaatactcctcagcaaatgcagaagaactgaaatctaacaaacagtctcgtagaccacagcacaatcaaattagaactcaagattaagaaactcactcaaaaccacacaactacatggaaattgaacaatctgcttctgaatgactcctgggtaaataatgaaattaaggcagaaatcaataagttttttgaaaccaaatgagaacaaacaacataccagaatctctgggatgcagctaaaacagtgttaagagggaaatttatagcactaagtgccaacatcaaaaagctagaaagatctcaaatcagcatcctaacatcacaattaaaagaactggagcaaacaaaccccaaagctagcagaagacaagtaataaccaagatcagactagaactgaaggagatagagatacaaaaaaaaacccttccaaaaaatcaatgaatccaggagctggctttttgaaaaaattaataaaatacaagaccattagctagactaataaacaagaaaagacagaagaatcaaacagacagaatgaaaaataataaaggggataccaccactgaacccacagaaatacaaacaaccattagagaatactataaacacctctatgcaaataagctagaaaatctagaagatatggataaattcctggacacacacaccctccaaagactgaactaggaagaagctgaatccttgaatgaccaataacaagttctgaaattgaggcagtaacgaatagcctaccaaccaaaaaaagccaagaaccagatggatttacagctgaattcttccagaggtacaaagaggagctggtaccatttcttctgaaagttttccaaacaattgaaaaggagggacttctccctaactcattttatgaggccagcattatcctgatatcaaaacctggcagagatataacaaaaaaagaaaacttcaggccaatatccctgatgattatcagtgcaaaaatcctcaataaaatactggcaaacctcattcagaagcacatcaaaaagcttatttaccacaatcaactcagcttcatccttgggatgcaaggctggttcaacatacacaaatcaataaacagaactaaagacaaaaaattatttttttattcagccaacgaacatatgaaaaaaggctcaacatcaccatcatcagagaaatgcaaatcaaaaccacaatgagataccgtctcataccaatcagaatggtgattattaaaaagtcaagaaacaacagatgctggtgaggctgcagaaagataggaacgcttttacattgttggtgagaatgtaaattagttcaaccattgtggaagagagtgtggtgatttttcaaagacctaaaaccagaaatgccatttgatccggcaatcccattactggatatatacccgaaggaatatatatcattctattataaagatatatgcacatgtgtatttattgcagcacttttcacaatagaaaagacatggaatcaaccccaatgcccatcaatgatatactggataaagaaaaatgtggaacatgtacactatggaatactatacaggaatgagatcatgtcctctgcagggacatggatggagctggaagccattatcctctgcaaactaatgcaggaacataaaaccaaacactgcatgttctcacttgtaagtgggagctgaacaatgagaacacatggacacagggaggggagcaacacacactggggcctgccagggcaagggggagcataggaagggagagcatcaggaaaaatacctaatgcattctgggcttaatacttaggtgatgggttgacaggtgcagcaaaccaccatggcacatgttttcctatgtaacaaacctgcatatcctgcacatgtaccctggaacttaaaattaaattaaattaaatttcaaaaaaaaagaatcttctaatttcaaagctttatcaggtttaaaattaaaatttatatttatatgtttgccaaaaaaacagtgcatatttattacttatagttatctgggttagaagtccaaaacaggtctcaaggggctcctcaaggtgtcagcagggctgccttccattttagaggctctaggggagatccattttcttgtcttttccagcttccagaggccaccacatcccttgcctcctgaccccttcctccatcttcaaagccggcaaggttgcatctctgacccttcttccctattcacatatacctctgaccacagttggaagggttctccaatttcaaggacttatgtgaataaattgggcccacctggataatccaggataatcaccccatctcaaggtccataatcttaaatcactctgcaaagtacttttgcaatgtcaagtaacaggttcacaggattaaggcatggacgtttttaaggggccatttttctgcctaccacaaatgtatatctttaactgcatgtcattacaatgattttttcataaaagataaatgaggtccttataactacagagtcttctattcttccactcttcctctgccctctcccactttcttatatgttactgaaagtgagtttcttacatcaagtgtaaatccattgcacagttaattctaaggcctttagtgtccctaattcctcttctttcggaggttactttgctgtatcatcattaaaccacgttaaaatatgttcatatcttatactacatgaaacttctatataactagagttgaagtgaatttgttgacaaactgttgtgtcttatgtacatttaattaaaattaattttttatactttgcagttttctttacttttttatatcccagctattttcatagatctcagaacagttcataggtccatagacactgccttaaagactcagtgaacaagaagaccctagatcaatagatattcttccaggagaaggggggaaggagaaagaaaaaaagaaaataaaagaaaaaagaaagaaagaaaagggaagaaaagaaaagaaaagggaagggaaggaggaaggaaagaaggaaggaaagaaggaaggaaggaaggaaggaaggaaggaaggaaggaaggaaggaagggagggagggaggggaaggagaaagggaggtgaaggagaaagggaaggaaggaggaagaaaagaaagaagagagaaagaaataatggagggaagaaggaaggaaggaaggaaggaaaaaagggatggaggaggagaggagaaaacttgattacttagtgctctctagtgtgaaaactcaatgacccactctctcttccagtgccaggaccatcgttcagaccatccatgagtaattcagtcatttgtttattcatttatacaacaaataattcctttgcacctgtaaagggcccattcctactgggcactgggaacaccatgatgaataaggccctgtccccatcctcaaggatctaccagtctttacctaatcttgtatgtgagtggacacacatcacctttacttgaaagaacggggctggcccactgtcagggaacctacctaccatcaccaagaatggctagatgagtaccaggtctttacgtgcatagataacaattcagttccttagctggcttctttcctattttgttataacttacatatagtgatgtgcacagattttaatcacaccggtctttcagtttgactgaaacccatagaacgtccccaacacccagaaacgttctcttctgcccttttccagcaattcctcctccctggaagcaacgactgccctgatttctcaccacgagttagctttgcctgttctggaacttcacatttgtggagtcacacagataaacacttgtgtctggctttttgtgctcagcaggatatttttgagattcattcatgttgttgtgaacagatcaataatctgtttattttaactgctgagttgtatctcactgtataaatagaccataaatgtttacccattatcctgttaatgaatattttgaaccatttccaattttaggttattgtgattaaagctgctatgaatatttttgtaaataattttttgtggatatatgttttcatttctctcagataaatatcaagaaatagaattactaggtcataggctagatgcacatttaactctttaagaaactgtcaagtcattttttaaagtggatgaaccattcacaatccacccatgatgttctggcggctccacatgctcaccagcatctggacttgtctttcccatcttttttgctctacacactctggaaactcaactcagaactctgtatttacttatttttttatatttttagagacagagtctccctctgttgcccaggcaggagtgcaatcacacaatcatagctcactgcatcctcaaactcctgggctccagggatcctcccacctcagcctccccagtagctgggattagaggtgtgtgccactacactcagctagttatcttattttttgtagatatgaggtctcgctctgttgcccagactggcctagaactcctggcttcaagtgatccttccactttggctctccaaagtgctgggattacagccatcacccactgtgtccagctagagctctgtatctttttaactggaaatgtttaatctagggtgtaaagaatgcttcagggaacctcaggtccctcctagaattgtagtttaaagtgtatgcatatttgtgagtgtccatttttctgagagaaggaaatgcagttttcaaaaactaatgaagtacagctctaagaaatacatttacatttgaaaaaacaattcttaagaatcaatggagcttttcttaccttctaagatggaactaaacccagaaagcaatccacaaactgctcctccagggacaaaggagtggtgggaaggatggtcaaggtttcctagcaagagcctctttagggcctattggaggcttgctccattaagattaaatcttgcaaagactgtaggctgacaataccttttgtctaagagtaagaaagagccctccccagccacacttgcgggcattcctcctactgatctggctgtaccacaaaggtgaactatgataaaaccaccttttcccccttacaacctacagcccccaaacagtatccccagacagcttcaatatcacaccagcacaactgatgactttgaaatctgcagatctaccttcatctgcgtagactccaaatatctcctcaaaatggacctgcttagaccttggaagccctgtctggataaagatcccttttccctgctgcaaaagtgcctagctctgctctgtccaatacagagccacatgtggccaagccgcacttgaaatgtgactggtccaaattgagatgtgctgaccccgtgaaatacataccagatgttaaacttagaatgaagagagaaacattttaaaagatctcattaaaaatttttctattgattggatgttgaagtgatcatatttgggataagtgggttagatagactattattaaaagtaattttacctgcttctttttaaactgtaactactagaaaatttaaaatggcatatgtgtcttgcattatatatctattctatcccctgatgtagcttattctgctctgcacggacatacgtcccaaaactcaggccagctctatgtggccatcatcacaacctggtagattagatgccctgggtccgtctcccaccccaccatctgcaagaacttcagcagaacttcttgtggtctttataccgggtgtcaaacagttaacactagcccctggtggtctgcccaggttcacaggtcaagcaagctgctgcctgtccctaagcccaaccatgagcctcaaaagaagcccatggccatgcactgatatgatgaagaagtggccagccagcaactagtgacacagcatctggtactgaagccaatcaatgaagtgcaaagaacccaggaagggggaccaaccagcctcctttgcctgagactggggagtttctgggaagtggaatttataggttttttgggttttttttagatgaagtttcactcttgtcgcccaggctggagttcaatgacacaatctcagctcaccgcaacctccgcctcccaggttcaagcgattctcccgcctcagcctcctgagtagctgtgattacgggcatgtgccaccaagcccggctaattttgtatttttagtagagatggggtttctccatgttggtcaggccggtctcaaattccccgacctcaggtgatctgcctgccttaaagtgctgggattacaggcatgagccactgcgcccttccaatttttagtttttaaaacaaggcaggcctaggcaagcgaaaataagctgttcaccctagacccaggtatgcacgtgagacctgattctcaggggtcctagggcagaccaaccctcccacccaccaacagagccttgagatatttgtgggatgtgcagggcaaatataaaaattccaaccgctgcaggcctcacctgggccactgccttccctgaaacaggtgaaaactgaaattctcaagccacacccactagagcagcaggaggaagaatgggggaaaccctttagcagtgatttggaatcccactgtgtccctcctccatgagctgtctgtgtgtgactgagcagctcgcttccctcactctctgggggtggggtcagggtggggagtctgtctgactcactgcccaagccacaggcctgtctgcttgtccccagacaggggacctacctacccactgtccttcagctctgttgtcagccacaggctgtgcccaagagggcacatggggttggtgtggggaggagggtaggtttccttggctgaggcagaggaagttgctttctgtctcaagttctgctcacaggtcagacattaccggccttgtgatcatcaatctcccattgtgtcctttcaacacgtaccagtgtcttcaacactaagtcccttgcagagggaatgggatagggaccgaacctcacatgcttttctgcttccctgtggatttgtgaggctgatatccaggtgaagagatcaagtagagttttgttcattcactcaaatgttcactgtgcctagtaacaggcagacactgagaaaattgctagaaatacaacaatgaacaaagttcctgcactcatgatgcttactgtctactgggggaaaccaacgataaaagagtcagtacaaaaaaaattaataagtgttaggggaggagaagagctgggtactgtgagaacacatatccaaggatctatcgtattctgggcaatcatggagtacttccatgaggaagcatggtttatgttgagacccaaaatgaggaagagttaacatatacttaactgtgtgccctagaccttcaaggatggggactgcctctctgagcagctgcagggaggcctctggagaggtctctacactgtgatgctgggttagccttacctatgagctgatacacgcaggcctcagagcagggcctaggttgtccccattcagggcggattctaggacctctctggaaggaagagaccccaggcgtgggagagtaggacctagtctcaggaaggaacacaggccctagattaagactgtgggctctcgaatccaacaatctgcatttgaatttcagggccatctctgagtctgtttcctcatctgttaaatgggagcaaaacagcacgtatttcataaagctgtggtgagaattttaaaaggcaatccatggagagagctgagggtggtgtctggcacacagcaaataccaaataaaaagtgagatttcctgctttcaattattagtgttacagtgaagaaagatacaaagtgctgtgggaaccgactacctcctatcatttatcttataggaacaatcatttaaaagaaactccaaaactggcaaaatgccacattgtgtctcaaggaagaaatattggatctgagcctggaagggtggctatgtgacttgcagagaaaaagtatgaagaaaggcacgaagaccagaatgggtggggcgcctgcaggagcagtgccggagtgctggaggggagaggagatggcagagcgccaggctaaagggctgggcaaggcggggcaggaggagccggaaggccctgctaacaacctttgccttcatcctaaaggcagcggccaggctactgaagatttgagagttggttggtgatctgttggggtttgcataggcagaatggagatttcctggaaaaaaacaggaagccagggaccaaggagggggctgatgtgagtatctaaggccacctcagacatttatcagaacacccagggctgtttcttggttctgtgccttgacaacacactatgtcctctgcttggaatttcaacaaacttaccttccaaaaattaatcaagtaattcatttattcaactagtattaattaagcacttatcctgtgtgaagctcagaatctctactctcaggaaattgatggtctggtgcaggggccagcaaactttttctataaagaaccatagagtaaatattttaggctttgtggaacatagggtctctgttacaactctaccattgcagagcaaaatcacccatagactatggaaatgaatgagcctggctgcatttcaataaaactttatttacaaaaacaggcagtgggccagatttggcccaagggctggtcaattcctgttaaaatataatataagccataaacatgaaccattatctatttaaattacatatgcaattaaaaatgttctagtagccacatttttaaaagtaaaataaatgagtgaaattaactttaataatgtattctatttgatgcaatatatccaaaatattattttaacatgtaatcaatataaaaaattattaatgagctatttcctattcttttttatactaagcctttgaaatttgatgcatattttacattgacagcacatgtcaattaggattagccacatttcaagtgcttgataactacatgcgactggtggccaccatattggatggcacaggtctagcaggatagtggagggtggctaggggagaggacgaatggctgactgatattggcttagggcataaattaactatgataccaatccagcttgcccacttgcttgctgggtaatttttggcatggttcttactaatctgggtatctttaggcccaaagtaacaaatgaggagttagctttagcccctaggttccttccagctcaacaatgtagagattccagactcagggtttagtggatggagtcaacaacttggattttctttgctaaaaagcaccttggatagtacaatcatcttgtactgtcttgtacttgtattcgcataaggctttctgtggcaaccccaccatccacatctccaggggcctgtgagggtggctgtctgctcctgaggggtcaggggatgtatacgtaaggtagagaagggataggagaatcgccctctccagctctctgagaaaaacgtgcccccctcaaacacacacaggcacatacatgcatgcatgcacacactcaaacacacacacaagaacacacagacacacatgcacacatgcatacacaggggcacacacacacacatgcacacacaggtgcacacacaggcacacacatgcacagaggtaacagctgtgatctccgggccttaaggtgcaggacatgggaacagaaatacactcctcatgagtcagagggtgagtcagaatgttctggagagcttcagaagggagcagcaggaggggctcatggtgaggaagggagccaggtccctaggggagagggagggagaatggtcaggtttcccagtcataaagccagggaaacacgtcctgtaaggaatagggtctgctgccttgccaatttgggtcccgaaggatagcctgtgcaggggaatgcaaagtgaggggcattaggagaaggagatggccttttgggctgccaagtagggaaggattcagacaggggtgtataaagccagctctgtgagacagatcacctgacctccgtgaaggctcagtctcagactgtcgcactgcagcagcagtgtttcttgaagcctgggctgctgagtgagtgcatggttgttgctaacccatgctgaactggggaaactgaggaagaggccacactggtgtcctatttggcccaggttgggacaggtgagatcagttctgcatggcagggatctgtgggatatactgactgtagcctaatttaggcacatgaccagggctggggaacagctaagccaccttgtggggctgtcagagctcaagagggctcgacaaaccatcagatccaggcagcagtctggcagaactgggtgggaggacaggatgaggacaccttcaggaggagccagggataatctgcatcaggagccagaccaaccaaaaagggaggggactgagggtcttgacagatgcagccaggcttgtgaagtggcccctacagtgtggtgctgggtttgatcacctcctggctgacccactcaagcctaagggcagaaactaggctgtccctagtcaagactgattccaggatgtgggataaaggggtccctgcagaaagaacccaggggacccaggcatgggtagaggaaactgagtgggcagaaatggcccctccaacccattccccatctgccagctctgtgtgcacagtgttcacatcaccctgtcttagtttgggttccctggagagcagagcctgcgataaggcctttggtacaggtagttgatttgggagatgaccccaggaagtactccaatgagtactgaaatactccaatgaacatttccttcgagcatcatgtttctgctttaaaagtttcagattttggagcattttggattttggattttcagatttgggatgctcagactgtatatgggaatattactgagatccttactgtaggcaaagggggcttgggtgtaccaggatctctaggaagtgtacagaaggcctcccagaattttccacctgaaaaacaggaagctgggacctttatccactagtctccatggctttatggttgaaggctgcccccaagagggctcacttcctgccatcccctcccctgtaactctggagaaagctgtggggcaggatgaggaaagatgtggagtgcactggaggtgggagtcaggctgtgctgccctctcacagctgtgcacccctcccatggcttgaaataaacttcagactccttcccatggcttacaagtcaatttaagccctggcccctgcctgcttttccaaccccatctccctcctccctcccccttgctcataatgtcatagctacaggtactgatgaacagccatactggtcccctttccattcccagaaactaccatgctccagagactttgcatgaaactctgcaacacatggttacaatggtcaactccttctcaacctcaggtctcagaaaactatccccccccttagtgagatctccccgataaatgaatctacctgaggtcaaatccccctgtattctctcccatatcccaggaacgtgctagtaaatgttaacaaatcgttctcaaagaaaaacaaaagccctcatttgttgtgtctcctaattttcataatgtaaatattcccatcatggtcaatatcaagctagcaacatgtggtcactgaatatggttttaggcaaagaagtacaacaatgcacaaactattatatattattttcatcgtatagatacaatagaagtaaaataattgagtcatgcatttcatttttcattttgatttttatataatttatatgatttattatattatatattatttatttattatattatatattatttattaaaatacatattatttatataatttaatgtttataatggctgtgtttaactactagctcacaaaaacccctgaaaatttaacaattggctctcatgagctaatatgaatcagcgccaattcatatcaccaacttatatcacctgtgtgcacttcttaaaatgtaattatttttcatccttgctttactctttttatgagagccttctagaatgtgggttccttgagggtagaagctatgactctttttttctcagctgtgttcttagaaaccagcacaatacctaacctacaataggaatccaataactatttgttgaatgaaggcataaatgcatgaatgcatgggcaaatgaggtcaatagggttgggcatgcctcctgtggactgaagagggaacactcatcttgagtgacccatgttgaatgccacaagtcttgttggggtgcttatgacaggggtgggagcagaacaggcccagaggttccaggctggagaagccagaaagtggtaagggatatgaatctggaatcattgctgaaggctcttgggctcccaggggtagcccctgttagggctttatcccctccctacagcacagttggccccctggcaggtggggctctcagacacatccaaagccagcagagttctctatcccagccctccacatgaggctttgcatggagggctgagcaggccacctaggttcaaaggtttgcccaatctgctctggtatatctgggatcccaacaattcctgacacccaggccagctgcactccctacgtaggggtggccaaggacctggagaaaagcaagctcagcaagcctgtactcatcagctctccaacgtgtgtccgaccttctgccagcccctccagcctggaagcctgctgtcctaacaggagacacctgacttcacctgtctgcagcacccagcacaaagcctgagcaaggcagatgcagggaatgcttgcagcatgaacgagccaatgagtaaggcagcttcccagcagagcacatgtgaatcagcagtatttcccactcaggccagtctcaggcctggcactgggaaagagcacagaggtaccaggccagctgtacccttgactgcaatccagggtagtggccaagaacccagccctagagtcagccagactggggccacatcccagctttgctacctgggccttcatttcatcatctgtaaaatggggacaaatcatcatagcacctacctcaacaggtgactggaagaatcaaatgaaattgtgtaagtaagaggcttgcaaatttcctggaacagcaaaagagcacaatagatttagcctttaatttgtgaatacttatatagcaaacttgttgtgccaggaactttgtgccttaagccccttaggagtattaactcatttaatatcatgcttgtattgaggtcttaatgctacactatactgcctctcattgtttttttttcttttcatttgtttcattgattttatttggattggtttgagttgggttggatttttgctgttattattattattacaaaataagtttcttcctctcgtttaatctcaatattcttttccgtaaaatggggcattgggttaagtgacttctcatccaatgttttcattgctatcaatctcctgtttcctgcctcttggttcacaccagctatccagacctttctacatctccatctgcagactggatcctactgcagggacctgacccgggagactgggcttaggagccaagccccaacttccagcccttcacagcttgtgttaccaggagaacatggaaatggtggacatcttgctcaactgggaggctatggagacaaatggtcactcatccccaactagggtatatggtgccaattctggtctcactttcccattggagaaagtcctgaaggatcggcattttaagattaaaatcccagaactgccaagttcattcattcttcagtccataagtattcagagcacccactgtgtgctgagggctgggcaatgctttgggaacaagggagggaatgagacaggaagatggctgctccatcaagtttagtacagtgggggaaacagaaaataaacaagtcaacataaaagtaaactctaactcctttcagaaagcatcagaagctacgaagagtgtaaagcaggctaagaaaatggattgggctattcacaatagcaaaggcatggaatcagcctaggggcccaccacaagcagattacataaagaaaatgtggtatgtatatgccatagaatactacacagtcgtggccgggtgcagtggctcttgcctgtaatctcagtactttgggaggccaagacgggcggatcacgaggtcaagagatcgagaccatcccggctaacacagtgaaaccccatctctactaaaaatacaaaaaattagcaggacgtggtggtgggcgcctgtagtcccagctactcaggaggctgaggcaggagaatggtgtgaacccgggaggcagagcttgcagtgaaccaagatcgcgccactgcactccagcctgggatgacagagtgagactccatctcaaaaaaaaaaaaaaaaaaaaaagaatactacacagccataaaaaataatgaaatcatgtcctttgcagcagcaacagggatgcagctggaggccataatcctaagcaaattaatgcagaaacagaaaaccaaatactgcatgttctcacttataaatgggtgctaaacattgagtacacatggacataaagatgggaacactcaacactgaagactactagaagcggaagggaaatggggcctgggggttgaaaaactacctattgggtactatgctcactacctgagtggtgagatccatacctcaaacctcagcatcacgcaacatacccatgtaacaaacttgcacatatacccccaaatctaaaataaaagttgaaattataaaataaattttttaaaaagacagagtggctaggaggatggtcagggagggatcttgctatggaagtgatttaggagctgagacccaaatggggagcaggtagagagctcagactgttaaatgagcaggcctgggtggctggagtttaggaatcaaggtgtgtgtgactacagagaccatgtaagtcatataaggactggtaagccatataaggagcttggatttcttctaggtgcaatgaggagccaatggagaatttttagaaggaaaatatcagcctttttacattgcattttatttgcctgtacacaagacttattgcataatttgtggggcccagtgcaaaataaaaatgaagggcccttatttaaaaattattaagactttgaagatgtcatggggccctcccaagcatagccatgccaacatggctgcccatggagccagccctgcccatacaaaatatgttggcattaataaagctttatttaaattagcaaatatgtattgatgacctaaaataagccagacaccgtgccaggcactgggggtatgaaaaagtgaatgatcaaatgaagaaagccattttgaccttaatttttcttttgattcactccacacacaaaatgccagcggactaacccgccttcacatgtttaatggtgatcagacccataaaggttcaggccatcctttgaatggatttgacttgattccttagtaataatgggaaccattattgcacatccactgtgtgtctggcatacatgatttcacataatctccccaccaccagccctcaacaagaaccatgcaaggaaagcacaaggtgagaaatcaagctcaaagaagagaattaacttttccatgttcattctgcttactggtaattattggagtggggatttgaacccagatctcgttgaatccagagtcctccctctctaggtgcacaatcctgcctcctgtacactgtgtattcaaatggctgctcaaactaaggatttagatacaaccttcaataatcttgagagtaattaatgtctgtggaatatttactatgttccaagccctacactaaactctctgtgtagatcttctcatttattcctataaacaatccccttgtgcatatagcactatctccatacttttctagtgggaagaccaagactaagaaaggttaagtaacttgtctgattcctcccagataataagcaatggagctgggagagaagccgagctgggagagaagcgaagctgggcagcccaagggtctgagtccttgcttctattccctgctacttcttttcctctgcaaaagctatgcagatcttgtttctgtggccagttggtcactttcctattggaaaggccagagctcagaagtccaaagagcctggcccagggagaaggtgtgggggtatgacctggtgtcaacatcagggctgaaaattgcttcatgccctgctcaagaggaacaggaaggtctgacttctcccctaaccatgggaaagagttacttttctaaaaaaagcagggccagaaacatgagtgtgaaatgtcagggccctttctacctcagcgtttccttttgtcttggccttttcaccaatggaaagagctatcttgaaagaggaagatgtgctcactcttggttttctaaccaaggatctgagagacttccctaaagaaaagcgccaggcaggaaggttctggggctgggcatgcctgggaaggctgggcccctactctgcactgcaacctcacagggactatcaagtcaggactcttcggccttactctggtattgcccagaagaaattattagagaaaggcaggcatctgtggatgcctcctggtacagcccattgccctcaagacacagaaaatccaagcgccaggggaaatggcagcacaggtccagaagcctctgtcagtcccagctgtgctctggtgtagtggactctggtgtcaggccaaggctgcatttcgacaaactcagtaggaattccacaatgctactcaattattgtgagacccatgcaagtccacaaatgactttggttctcctgatccttatttttctgaattaagtgatgtaacttgtattaagaaacatacaaatagggaaatctaattcttggtctcagtgaagttgcagaagagcagctgagggaagttgtgaggactaagctcaagggtgcagaattattattacctgataacatagcatccagctgaattgctgaatcttggggtctaagttttgtaaaagaagaactacatgccctttcataccagaagtcccccattctcatattcttagcattgatttgtcttacatctctatttcaagtctctagatctctaagagtgtctatctattgcttgtacttcattgcttttactatgaagtcttcaaaatttttaggttccaaatttctcccttcaaaacctcgtagcggcttctccatctagaagaacaaaagaaaagtctgtagatagccaattttttatattctttttaaggagcattttttcttccttgatgcttctaatataaaaataaattatcttcataattgaaatatttttgccagaatgtttcaggtgagaattcctttgaatttatttttacttggaatgttgtgaatcttttcattttgcatgctcaatgaagttttatttaagtattaaaaaaaactatcacttattaagcattcagagtcttatgtgaggcacttttatagattaactcatgtaaatcttaaaaactccttatcaaaaagtgattaataagtatcatgactaaaagtaatggatgtctgagtttccatccaggaaaggtctggtaggagcctttccaaccaggtcacctggggcatgttacccaagcactctgagcctcagtgttctaatctgtatgatgagggtagtaatgatacctacctcattgggcggccctaaagactaaatgaggttacacaagtaaaacatttaaacaaatgtttaataataataaacaaattcccccataataaacaaattccccaaaggtgcagtatacaaaatcaacacacaaaaatcagttgcattactatacactaatgatgaaatatccaaaaagaaattaagaaaacaattccatttatatttacaatgatatcaaaaaggataaaatggatcaagtgcagtggctcacacctgtagtcccagcactttgggaggccaaggcgggaggatcacttgaggtcagcagttcaagatcagcctggccaacatggcaaaaccctgtctccactaaaaatacaaaaattagctgggcatggtggtgtacacctgttagtcccagctacttggtagacaccagaatcacttgaacccaggaggcagaggttgcagtgagctgagatcatgccattgtactccagcctgggcaacagagcaagactgtgtctcaaaaaaacaaaatggataaaatacttaggaataaacttaaccaaagaagcaaaagatttgtatactgaaaaccccaaaacattgctgaaagaaattaaagaagatgcaaataaatggatagacatctcttgctcatggattagaagacttaatattgtccaaatgtcaatactactcaaagcaatctacagattcaatgaaatcgctatcaaaatcctaatggcatttttttggcagaaatgaaaaaactcatcttaaaattcatagggaatctcaagggaccctgaacagtcaaaacaaccttataacagaaaaacaaagttggaggtctgatttcaaaacatattacaaagctacagtaatcaaaacagtgttgtactgacataaagacaagacacatagacaaatggaataaaataaagagccagaaataaatcctctcatgtgggtcaagtgatcttcaacaagcgtgccaagagcattcagtgaggaaagagcaatctcttcagtaaatggtgctggggaatctggatattcaaatgcaaaagaatgaagttgtaccgttaccttataccatatataaaaattaactcaaaataaagacctaaacataggctctgaaactctaaaactctcagaagaaaacagggagaaaagcttcatgacattgagtttggcaaggattcccaagatacaactgaaactcaatatgtttgaaactctaaactctaaaactcgtagatgaaaacagggagaaaagttcatgacattgggattggcaaggattcccaggatatgacaccaaaagcacaggcaacaaaagcaaaaataaatgaatgggactatatcaaatttcaaaacttttgtgcatcaaaagacacaatcgacagagtgaaaaggcaacccacagaatgggaggaaatacttgcaaatcatatatctgttatggggtttatatccagaatatatacagaactcctacaactcaacaaaaaacaaagcaaaacaagaaacctgatttaaaatgggcaaaaaatttaatttaacgtttctccaaagaaaaagcatataaaaagatgctcaacatcactaattattagggaaatgcaaataaaaattgcaatgagatatcaccttacacccactaagatggctaaacttttttttaaaaaagcagaaattaatgaatgttggtaaggatgtggagatattagaacacttgtgcactattggtgggaatacaaaatagtataactgctatggaaaacagtatgatgattcctaaaaaaaaataaaattaaaattatcatataatccagcaatcctacttctgggtatatatcccaaacaattgaaagcaagagctcaaagcagcattattcccaatagccaagaagcataagcaacccaaatgtccaacaacagaagaatggatacacatacaatgaaatactgttcatccttaaaaaaggaaatcctgacacatgctaccctatggatgaaccttgagacattatgctaaatgaaataagccagtcataataaaacaactactatatgattctatttatatgaggtatctaaagtagtcaaattcatggagacaaaaattagaatggtggttgccaggggctgagggaaggggaaaatggagagtttctcaatgtgtatagagtttcagtttagtaaaataaaaaagttctggaggtccattacacaacaatgtaaatgtgtttaaaaatactgaaatatacacttaaaactggttaagatggtaaattttatgttataggttttttaaccacaatcaaaaataacaataaggtaggtcatgatggttcatgcctgtaatcccagagctttgggaggctgaggtcagaggattgcttgaggccaggagtttgaggctgtagtgagtgacaatcgcaccacagcacttcagcctgggcagcagaacgagatcttgtctttaaaaataatttttaaaataaaaataaaacactgcacctggcatataatagagattctataaaggctgacttttatacaaatctcttttcctaattaaggaaacaggagttttaagaggctgagtaacatgccccaaatcatacagctagtaagtaagtggtgatgtgggaatttcaactcagtccaacccaaagtccatgcatgaccttaaccatcagagcacaacgtttcatgcctcgcatctgtttgccatacaggaggctgcgaatgcagagaacttcctcttctatcagtcatctagcacagggaacagaatcgaggctgaaggacagcttcaagccccttctccatccaagctttgagatcaataggctttagcccctctgaaccaaccatgcttaaagtttcagaagccacagcagctggcaggctgatccacacacacagatttcttactaacatcatgttcttcatagttactgctgctgaggaaataagcccactccctctgatagacagaaatcagacaatataatgatgaaaagctaccctcagtctccagctcaacactgtttcaagcagcaacaataggcaaaacaaaagtgtgaaattaaatctacttgctatccctggaagagacaaacaagaaaaaacatacatatagacattgaaatattgattcttatgtgcacaagcacaagctctgtggaagcacagaagaaaaagtgaatcagcctgtaatcccagcactttgggaggccaacgcaggcagattgcgaggtcaggagttcgagaccagcctggccaatatggtgaaaccccagccctactaaaaatacaaaaattagcccaggcatggtggtgcgtgcctcagtcccagctacttgggaggctgaggcagaagaatcacttgaacccaggacgtggaggttgcagtgagctgagattgcaccattgcactccagccggggcaacagagcaagactcagtctcaaaaaaaaaaaaaaaaagaaagaaagaaaaagaaaagaaaaagtgaatcagccacacaggcagactgtctcagagaaggcttcctggaggagttaacatgggcactgggtcttgaaggataaataggggttggccatgttaaaaaataaattaatttaaaaaagagagggcgagagatatgcaccaacagagaccaacagacagagaaatctaaagggacacggctgaggaatagcccatcatttacatcattacctattcattcattcattcattcatttgttcattcaaaaaagtcagtgaatgccaaatacatgctgaccctgtgctagcttactaagaaagcaaagctgattctaacttccagtagctccctgggtacttgtgggacagtatgggaggtgtgacaagggtgtttccagtggatgggggtgaggagaagggattctatctgcattgcagatggaaaaagagggtgggttttgagttccattttgggggatagaagatttaagattctgtgactgattatattccagggatgggggaaagagaaatctgggaaactgtcagatctccagcataggaaatcaagagaggggaatgaatgagagtaaatatgtttggaaagttaaaaactagctcaactttaaaatcaactttctaagtttgtgggcctagaaagccttcagactacaaaggccatgagggcaagaataagaattgcagcaccttgaagggcacacatccctgcctggaggacctaacaccattatgggggtacacataggtgctaaggaatacttgatgagctgacttcctaccacactgtgcttcagcccagtcttactcagcaactgctctgcaagacatccagatcatggaaagccaggtgagcaaacccgcctttgtccacaccccaccagagctccacactgtaggtaccagaagcttcctgggcatccaggaatgacacaaaactgtttctcttttcaaaaactgaaatgctcccaagattgaacgtgcggaacgcttgtgcagctataatctcagcaaacatctgccacctttgtgtggcaaatgcagtctctttagaatactgcctttgattttggggaaagacaaatcaggctgcacgttttgttctgaatgcgtctcatcacaggaggaaattttcagcagcttggaattctgaatgtatgaaaaatgattttttttaaacaaagagttcacgataaagcatcaacaaggttcctaaaagagatgaaaccagttctctattcccatccctttcccctcccacgtctcgtctttttctggattctccaaggtctttctctggagctgagtctcacttatattgccatttgcagatctggggtggcagctcttctggcctcagagggttaggtcaagactgccagtggcccaagtcatctctacaaagtgtgagctacagaataagccagagtctcttctctcttggtgtcagacctcactggtgtttgtaaatcatcaaaatggaaaagcatttgtgctgctggggaatggacctgagatgcagcccctcacttcacagcccagtaataaagagttggtgtaaccaccctggaagcagcaggtggggaggaacagcattaggctgacctgggttcaactcctctcttctctgccgtctagctcagtgatcctgggtgggcaccttgaacctgctggatctcaggtttaccatctgtaaaacaggccagattaaagcctgccttgtcatcagaagcccataggtgaatgtgggcacatctgacttgcaaacaacaaagtgaagtgcagatgtagagtaatcaactgtccaggctcacctgggactgaagagtttcccaggatgtgggactttcaggagagttccagacaaaccaggagtgtggatcaccctatgtcacccaaagctagcaaaaccccatcatgacagggataagaactaaggtcgtcaaaggggtataatgcattttctggaaaaatgcacactgactgattcactaaacaaaatatcctgagaattttatgagagggttaagcaagaggctttcttattctaatttagtcctccattcacactggagagttcagtaaagctttacatctatttcataaataccggcatcacttcacttttgctaacagggcacccaaaagcataatggcttaaaacaacagtcatttatgtacctcacaagtcagtggatcagcaattgggctgggctcaacgagggacttctcatctggactcactcatgtatctttggtcaccagcttgtgcatctagggctggctggactaggagggcctcagctggaaaggcatgttttggctccatatggtctctcatcatgcagtagccttgttcacgtgacagctaggcagcgttccaaaagagtcacagcccacaaggcctcttgaggcctcacctcagcattggcatagcatcacttccaccaaattctgttgtccaaagtggatcatagagccagcccagattcaaggcgtggggaaacagactccaacttttgatggcaggagctgcagagatatatttcagaggggcgaagatataggaggtgagggggagaactccaataatttttgcaattgacagtatcttcctttttattttataaaacatagaaacaaggtacttcagtagctataacaatctattgctatatcattgccatctctctagtcactcaagccagaaaccttggaattctcccaaccggtctctgcctcattcctgctccctctacacccaaccaggccctgccatctccaccatctaaacattcatcacataattccctgggattattcctattcatgctccccacctccagcctcaccctctctaatccattctcctccccacagccaggatgatccttctaaagcatgcatttgaacatgtcactctctttactgaagacttgattagctctttactgctgccaaattctacctatcaaagcctttctactttctactccagatattccaccttcatcaccaccgccaaatcactactgtggcacctaaactatgttctgggcagagtgaactatttagcttttcttaaacaaatcatggcttttcatgcatttgaaaatgcaactcaaacttacaggaatgtttcccaagacctagatatctgttatcagttaaagctagactgcaaactcacctgcatgcctagaggactatctacttgtacatctttctatctctgttattggatatccccaaagataacacaaaccatttattgttcaatgactttgttggtgaaaacaacaacgatgatgctaaaagataaatcaagcatacagattgcttaatggaaaaagttatttatagtcagccttctgtatccaagagtcccatatccacagattcaacgaacctctgaccaaaaatatttgaaaattaattaattaaaaataacaagacatcaataaaaatgacacaaatagaaaaacaacatagtgtaacaactattttgtacttaacattgtattaagtattataagtaatctagagatgatttatagtatacaggaggatgcgggcagcttatatgcaaatagctacaccattttatgtaagaaatttgagcatcctcagatttgacatctgaaagggatcctggaaccattcccccatggataccaagggacaactccctactcacccttgttagttctggaaaatagttacagtggtactagggcaagcaattgatgacagaattatagagtccttctgggcgtaagacatttgttattcatctgagcccatagatgaaaacttgagagccactgaccgccactatcatctggaaccagccctcagtacctctccagtgggcaactgcaacatccttctcactggactcctcacttctactcttcacctttcaacaatccgttctacacatggtaactagagtgatccttttaggtaacaaatcagggcagatcaccttcatgctctaaaacctgcagtacttccccaatgcactgagagcaaactcttccatagcctacaaagtcctacacaatctgcccctgtggcctccacagtctcatctatcactctccccgtcacttgctgaaccaacaccctggacttctttctattcctcaaaaatgcattcacaggacccacacgtggctgatcccacagctgcccccaatcaccatctggacttttgcataactgtctggctccaccaggtccccctcaaatgtgacccctcagagagcccttccccaatgtcattgaaaactaacactgtttgcaagtttgtttccttgactattgcctacctccccaactggagtgcaatctccatgagacctgagacccaagcttactctctgtacatcttcaacatccaaaacagtatactcaataaaagttggctaaaggaatcaataaacaaatgaacgacactactaacaattatgaaagaaagataggtaagtacttaatcagaataaagataaatgccacctctaactcaatagaacccgcctaccacctctacacaggtgagagaaacccctcccagctccaggctcagaggcctctcgagagaatatgttgtcttagggctcaggtgaagccctttcaagctggcttttcattatatctctttaaccacggtgataagtagagccaggttcccctcttattggtaggaccaaattttctcactcaaaaactttactatgaaagaaatggaactcaggtgccttaactatggcctgatcaaaacttgacaacaaagaaataaagcagcttaaatgagttctggaattggctctctaaagaccccagcatgggagagatgcacacatatatctaatgcccaccagcagctacacttgcatgtcccacagggtctgagactcactgggtacaaggcaggttcattatctgggtacaaggcaggttcattatcttcctccctacacccacccaacttctccctttgtcagtgtcactgatgtctctgagtagccaacatcttccagttaccaaaccagaaacctagaagtctccgtggacaattccctttgcctcaagtcccacatcctcctcatcctcccctctaagcccatgttctggttcccatctccatactcccactgtgtccaaacagtcattattgtctgccccctagacaatcacatttgtctcattgctggtctccccacatctactcagacatccttcattctccccgcagcagccagaacaatattttaaaaactaataataagcatgtcctacagcttcttaagtgcctgctatgccttccatttttcttagaatagagggtaaaccctcaccttagcctgtaaagccccatatagtctaccactgcccatctgttcagcctggctcacactctgtggtcctccaacttccatgtcctcaccctaagggcctccttttagttctaattctcttttttagttccaactctctttacaaagactttgcacatactggttactttgtatgaaaccatctcccactaccaaccatgagccaccttcttgtccattcttcagatccctgctcagttttacttccatgggaaagtcttccctggccatccggtctaggacaagtctccaaagaatgatagtttttcctttaaaacacttatatctgtttataattatggattcttggcataactatatgactataaactccagagggcagagacttgtctccctttgtgctgctttgtatgcccaatgcttagcacagtacctggcacaggatagatgctgaaaacaatgaacgagtgaatgcatgaatgaatcaaggaactaggaacagctattctgtggagttcagctcaccctccagcagctggccaaagtcccatatttagcaatcctcatgagagatgggaggggtagataagctaggagtgaaaagtggaagaaataaactgagtcgttgaaagattaagaaccccatgctgaatctgcccttgtttccatgtaacttgcaagaacccactgtaatttacatatttctgcacgaacatagcgtgtaactgactcccaatcccttctagatggatgacacatttactgtctctctttgggaattttatgttgcatcctggattccttagaaattggcggagagaggtgggaagcaaggataggtaaaacaaacggggtttgccattgtcaatatgccaaagagaagagacctggtaagatctaagggatgttcccagacactcactttaatcatcattcctatgaacacacacacacacacacacacacacacacacacacacactattgctatgagaaagaagcaaatcattcagaccactaaagcaaatggtcctgaattacctatcagccagctgatatagtggcagttttcaccacataccaggcaccctgctaggtgctgagaatgcaacagagaacgggcctctaggcccagagcctgtgcccatggactacagagtggtgggggctgtaactttgaacaggctcacactgtggtgtaaacaaagctgagatggaagtgcaggggccagggcagcacagagaaggggcacctgacctggccttggaggtcagccacgacgtgccagaggaactgagagcaaagctgcatcgcaataacccctccgagcctcgacttcctcatatgtaaagtggagacagtgagtcccacttcccaaggggcttaagagtatctgattcaaaatcataatcgctggctaatacttaatgatcacctattttgtaccagccattgggctaagcacatcttgtgcattagctcatcaactcttcatcacaactctagaaagtagatacaaatatccccacgttaccaatgaataaactaaggtttagggagatgaagacacctacccaagtcgctggcaacccgggtctgcctgacaacacgctttgaggcacagcacttcaccacctcccttatgtaatcatgacaagttctcagcccaaaataaacctttagtgaatttcagtttcttttctcccttcgtcccctcctctcctttctccatagaggaaacaaaacaacaaagatcccagagtgctgtgactcgagccggtttccctggatttcatgaagccactttttctgtataaatatagtctttgaaaggacctagaaggggaaatcagaatattgagaattattcccaccttaataataataagtcaaattggtgagtccaactgaggcctcaaccttaacccaggggaggtcctggggcagatggctctaggctctgcttcctctggggctggaggttactaagtttaaagcctggttgccaacagatctcaacaatgaagtccagaaattagtaaagcctacaaagtgctcagaacacaacctccctgcagtcccccatggcttgtgttctataagatgcagatccagctgctgctctgctggcccatcctgaggacttggcaccatcccacccaggaatgtatcacttcactggcccagccctgccttcccctcttccacccatgcccagctcattcactgtatttcaaggcttgacctcatagaaaatgtatgtattcacccattttatttattctttcactcattatcagggtcctactatcatgcatgcatttgtggattccccattgtgctgatattctgagtacgtttgcagataaaattggaggaggagatctgcctcctggccagttgccgcattgctcacttgactgagagcatgtgtctccagctgtcagtcaggctcctccctgcgcttgattccaaagctgcagaggtcagagttataggactgggaggcttaagacactgggatggtggccctgccttctccagctcagctcagctcagctcagctaagaacaatcaaggtcaggtcagctcccagatcaacccaaggacccttgggagactctgcccccaacaggtaagggctcagagaacattgcttgttctcttgcacaggcagcaaggctgggtagttactgggctaaagggagccctggactcctgagatacctctaagaatcaatccccagaccatactctttgtcctgacctacatgctcagttgacctgaccttttagtctccagcaaagtaatggtgtgcacatggagtcagccaaacttgggaccatagcctaactctgtcatcttctagtttggtgaatttggacaaatcgctttatgcatctaatcctcagtttccccatctgtaaaatagggatggtaataataattgtagtacctgcttcacaggcttagtttgatgattaaatgaaataatcacacaaagagagttttacccaaagtttctcaacttcaaaactattgacatttcagtccagataatttttggttgtatggagtatcctgtgctttgtaggacacttagcaggatctctggcccctatcttctataggccagcagcccacctcctgctcagttgtgacaactcagtgtctccagatatttctcaaaatctcctgacatcagccctgcttgagaaccactggttaacctaatgccagaaaaataacaagttcaattaatgttagctattattattattgcccactggaacccagtctgcttggatggtctctggccctgtccagccctcaccagctccatagcctaaggcttatcctcaaccacaattttctatgtactaggaggaccctgattcaaggtatttggaattatggcacagtcaatagcctgacaatgactagaaatgtatctatgccatacaagatctgtctccctgggaatataaaggaaagaattggaggaggacaggagaatcagggagacagtttcccaaagcaatttagggctcagaaagagaatgaaaattggtgttgaaagtactaaagagcataaggaaaatgatagcattcaaccaatgtaataagacataaaagaaatagagatgataatatactattggtactgtcaacatggcactcagaacccatgatggtagatgtgttctgaagaccaaatgtgtttatggatgtaaaagtgcctagcccatgacctggcaaattgtagaccctcaataaaggtcatataaaactatcattcaggttgacattttttgtcagggagaatactggaccagatggaattggctcagcattctacgtcagaggtgggagcgatcattgagacaatgtgacccagctccttcattttacagctgaagacatttacatggagagaggagaagtagattgggaaaaatcacacagtatgtaaatgccaaaaactaaaattagaactaggttttccagactctacaggtggctacagtgcacatagatatacacacgtagatggctctgtcctaagaccagcacacttgagttacctgagagtcagactcagcagctgaataaaatcatgagcaggtgcatctgagtaatgtggtattgtgctactccctgccttctggccttggcatcccccaaacagtcatcctaaccctcttgactctgctaccctgtgttcctggcctcgcttccatttttatgcctctttcttctctctactctcctctccaaaaaaccctgtatcagactcatctgatcccatgagagtagccagattcctcctcatttggtttagcatctccttcctgacaacaactaacttgcactggatatgtactatgtgctaagaattgaatatgcattacctatctatataataacagtcactactattatctccattttatagataatgaaactaagcctcagtttcatgtacaggaaaggagaggcagagtgttaataagtagaattaaaagagactaacatatcaaaacactaactagggggaaacatgattttcctagagtaataggtagatgtggttgaatttctaaagagaatgaactagtttagtctgaagtccagggggaagtggcagctggcgaagtctcccagaattgtgtttttccttcatgtctggtaaatatgggatcaccaagtggatggggaatgggagggtagtgatgctgggcttcttggtcaatgggattcacagccatgcaatgacatctccctctctgcggcctccagtccacccagaggtctgtatagccagactctcatttgtcctcacctgtttcctaaatcacaggtggggtagggactacagggctccatctgtcttgacgcccgacctccagctcctgatccacttccgactaatccatctgtggagccatccaagactatgacccacttcccacagtgctcctccccagacaagcttccctgtggacggtcttgtgccctagtgttcctgcagcctgcgggcacaagcaccgcctgttctggacagctccgcccagcccagccctcacctgggtgttgtcctggactccaccctccccttccccatctcagcccaagacttctggctccatctgctctggcctagaaatgtctctctcacttgggcctttgtaacagctgcttttctcaatcaaatttcttgtccctgatatacttacctctcaaaaatgcaaatatgttaatatcaggttattgcttaaacacctgctgtgtattcccatttcttctaggataaaacccaagccccatggattgagggtcccaccctgaagctgaatctatcagactaggatttcttctgccaggtgagtctagggaagatgatgttgcttaaagtcaaacactagggctttgagacatttggccttatgctcagcaacctttagatggtagaatcttacatctaaaaacgaccctaaatcaacctgtccccatgcacactagctcttttcctgatcgccaccagtgacgaggcactcacgatgtagtgagacagcccattctgctgtgtaaagaactttcttatcacaggatcctagactctcagatttgtaacacactcagaaggtgttattcttccacccagtggaaacacttctctgcaataaatgagcaaataacctgatcaattttcttgaaatatccacactgtgatgtaattgtgttctggaatccaaatgcaggcttttgcctctttcccacataaatatcttccaccataaaaaatatgtttggtttctggattataccaatgtggtactcctctcagttgttttccagtcagaagtttcacccacttgcccaagggtgcagactctagagacagttacagatagtctaagttaaaatatcatctctgccatttgcaagctgtggaaacttggttgagttacctaatttctttaaacctcagattccccatctgtaaagatgatacctacctcctttagctattatggggactaaataagatattatataagctgctaagcacagcatctggcacatataagtgatcaataaatgttattttttattatttaaagtgaaacttttctctatgatgtcagtgatggctttcgaacattttttcctagaatcccaatattcaaaatagatgcagtatggctctgatggcagcatgggcgggcatcccagggtcccattgcctctgcctttcctgtccctatttcctcttcttcatggcacccctgtgccatgaaggggtgagacacccctatggaaccttaggactcttcccagtatagtttgaaaataaatgagatataaataaataaataaaatgtcataccaggaaaaggcaattgcagaaacacaggaatatgtattactttcctattgcttctgtcacaaacttaatggcttaaaaatacacaaattattatcttacagttttgtagatcagatgctcaatgaagatctcactaggctaaaatccaggtgtcagcagggctgtgttccttctggaggctctaggggagatctcttttcttgttttattcaagtcctagaagctacccacattccttggctcacagccccgttcctccatcttcaaaaccagtaatacggcatgtctcagacccccctcgccaactctctcttccacctccttctcctacttataaggacccatgtaattatattggtcccacccagataatccagaataagttccctattttaaggacagctggttaacacattaattccatcggcaacctaattccccttcttgtgtaaccttacataacacattcacatttctgaggattaggacaaagacgtctttggagaatctttctgcctgccatagcagtcactagagaggtccttagagaccagcctggaaaaattactcaacatttggagacataaacgtcctattcacctcgctacaatagtttgcagcccactattcttcatcttgttcttaattttaacatgaggatctttgacaaatcttgctacagtcaagatactctgtctggcattacccagacttaccagatatgaccatcctttcagggagatttgttgcaagcaacagaaaatgactggctagtttaggcatagaaggcatttgataaaaggttattttgaaccttgcaaagcctctggagggatggagaaccagtgagagatcaggcagccaagaacagccccccaagttatatggtagaacccatctgggcagaaattgttgctagtgtccctcaaaacccactggcatagacagaggattctgccttgagtgttgctactaccatcacccctagaaattcaattgataggtttgattcttcacctacagtcactgctctttggcatttcttaaacccaacttgaagtcataggtggctgcctctatgttatgtctttgtggtttccctgtcagtcttatttgaaaaacttggagggagaggtacgtcagaagaggactgaaaattctacatgttccatttcccagcctctctggccagagaactctggcagatgctctgaaaccttgaacacctgccagagtcctgccagagaggctgggaaatggagcacgtgacattttctgttttatggtaaaagatgggctccacatctcaccaagatccattaaggggcaagttcccctatataagtccaaatggtggagacataattatgataatagcaaatatctacagcaccagcctaggaagcttattttttaaaagagaaataaggacattttggaattactagttcttggtgaatctatcatggctcttattcctactgatccctacttctctttctaaatacacataacccatataccacttaagtaatcatttctagttctttgccagaaactggcctgaacccacaatttctagaatccaggttttaaagatcaagataagacatgcccatccctagtcttctggcatccctctccctccccatttttcaaataaggctgacagggattccacaaagaattgtgcaagtcttttcagaaccctgggctataattcatatagaactgaagagctgaattaattaagagcagtgaggtgtttgcatctctcctatctcttatcttgagtttcaatctttccagattaaaggccatttgccttgatgaattgagcagcttggtgatctctctgattactctcaacattacaccgtcatgcccatgctgtggactctcctgttcccacgatgtatctccaaacagtgcaataaaaatccttatttttatttttagtggtttttcaaaagccttcactcttcttgagcctaggctttctgacatgattcttataaacatgggtcatttctcctggggttttgctgtattcgctttcttaatatttgtgtctgtaacacccacacccatcagagatgatgctatggagtcacattgctttctagttcactcatctctggactatacaatggaaggaacatggatgttgagatcagatttagagtacttgaatcctacctatatctcttactagcagtgtgagccttatctctaaaattaaggtaataattcctgctcactcttacagagcttcacaactggatatctttgcggcagtaccttgtgggcatgcttttattgaggttttcttgggttttttccctttagtaaacatacagttttacccgtttgtcgaaactcctgttttcacatcccttaaaagcagatggacagaaagctaccaaatttagagggttctttgagataacccaacataaaatacctgtgtgtgtgacatatatatgaatatatatgtcttgtatatttgttctgtttctctggagaatcctaataacatctctttgtgtactttattttcacatatactgattctggctagttttatatgccccactatgagaaaaaagtatcaatgctatatttactcatgatgccatggcacttcagaacctgtttgttcgggaacaatatatatttccatgcctatgcagttccctagtagcattttttaatgccagttacatcattactcacaatgctgcatcatctgctgtgccacctatgaatactggcttccagtgactcaagaagttgttactaagcttcattgattaagactacaaatgcaagtcttactcagaatatgtaggaaaatgtgaatgataattcatttttcacttatgtcaaatttgccactcagaattttacacatagaaaaaatgtatcttccaaccatgtctggaactctctggtctacaatcactgcatttttagaatgtgatctctttcagtgttgaccacattactgtctttcattcacaggcatcagtgggagcacaggtgggggcttatggaagaagtaagaagagtggctttatttacacaagaaatatctaccccttgccacatggcttacgatcaacccagaaggccacattacacatcagatgtgtaatagggcattgcaaaatagggcattggtgagaaggattcattggcccatctcaaaagcccttggagtagatagtcatggccacctctggcagccatcctgacatgtattaaggagcccattcagtggggtaaggtgactgccttgggtgtcagcagtgaaagttgcacaaaagtaggggaatagtggtaaggagtgaggtttgagaggtcaacaggggtcatagatcagcagggtcaagtaaaaaaagggctggaaggatgggcaacccaagcagcaggaactatgtgtggaaaggcatggagctttgaaaggagaaggtgcatccaggaaacatcggttgctcccttgtggctgaaataacatgcatttatggaatgtcatgatagaaagttgggcacaagagcaaacccagagttcattagcttcatatgtcaagcaagagaatttgagctctatctgtaagtcatgaagacttcatggaatatcttaagtaaaagatagacatggctggaattggggtttcaggaaaaacactgtggcagcaatgggaaagtcaaactggaagacagagaaaccaaatagaaagaggttattttaattaaccaggagatgatgaggattgtctctgaactcgataccaactgaacttgggaaaggagctgttgggctggagagaacacagtagactctaacatgtttcaggggccaaacagacaggatgttgtgattgatgaatgtaggaatgaggattggggaggagtccaggatgactcccagcttctacccatggtgcctgggtggagagcagtgtcattcctgaaacagggaacacagaaggagcaagtttggcaggaaaggggatcaattcaggctggaacttgctgagttaaaggagctgcaggacatagaacaggaggctcccagaagacaaggaacagattcaaaagttgggagtgaagtttggcctcgagaaagtcatggaacccagagaggattctggaatgagaagagagctaagaggaaaacctaagaaacactacaatttaagaaatggttatggtataaaactcaagaattgaaatacagaagaccctaggaggaaagtccatcttccaagtattggaaaccacgcccaattccttggccaagttttcacaatccactatccacacacacccatattccctcttttcttttccaatgacaagtaaaaacacaacctgcatcctcaccacatgtacaaagtcctcgtacaaaatttctctagagcctaacatgggtgccctcttgagtcaacaagaatgaacactgccagtaagtttgtagaaagttgacttcaagaacatgacacatgctcacagtaggatattgccaaaggactggtcatgagagccaatcagtcacagccaccagccctgaaggacatgagtccaggaacctagagtttagacctgtaagcaattaagggtagaaagatcttcaatttatttttctcttccccattttcaggcagagaaactgatacccagagaatgaaaggattttgtccaaggtcagcagtgaaaccagttgaccagatcagtgtgactaaattatgtcatgttggttaaaatgtcctaatgggcagcacatttctaaagtttctgccaatgcaaccaggcaccatgggcacacttcagaaactaatgagtctgcaattcctccagctcattcagaagctcctgggataagactcaatcctggtaaggcatgggagactgaagaaaaggtagaagttatcacccttcatagggcttaatggactgtggttgtcacatatccctccctctctgaggccactgggatctgaatttgtcctgggcaggggctttggggtcatttaattatcataccaaggggacccaacgagggaatccaaacttgtcttgaaaaagtgattgtcttcaaaactagcctgtgtcagaattttccttcccaaaaatagctgtccatgggtttgcattttcacagctctcttctaggcatcggcttctggtctgaccttggttcaggacttcccctttagatggatggatccagatgggtctttctgaaacccccttttgacaatatcactctctgctcgggagaacccagtgctctcctccacctacatgcaacttagtagacatcctagccacagcctgagcctacagcttttccagccattgcttctttttggttccctcaagttctgtcactttgggtgtcttccagttccctgagcacaagaggtatttttaggccccagtgcctttgcacatgtttcctggaataccgttttccttgttatccactgaaagcaactcccatgtattcttatttatttaaattttttgcatccagactttgaattcctcaaaaacagtaactggtgtcataatcaccttgttatccccagcacatagttcaggatttgtcaacatgttggaatgaatgcctatgagccaatcagactacttgccacagtcaggaggaagaggaaggctggagtagctgtgaatagtacaagatgaacctccttatgagtgtgaaagagggggagcatcaacagagttaccatgaattgacacagtggccatgtttccacctggtggaggaatccatttttaactcaaaccatcctcgagaagttacttttcctaccagagaggtggcaggctaagaataatccccttcattaatccctcccaacaacttgaataatggatggaccacagggagtttagaagcccaggttaagtttatgagttgtaaatgtagctctgggcacactgggtagggagataggggtggtccctcgaacagaaagccagggcaactatttcccagaataaattagaagcatatctccttatgaatactggggaatgccattgatgttccataaagtaaactttggtcaaaacatagcagaagctggagattttctgcaaacaaacagtaatgtgaggccagacatgtgtaggcaagaagagcaaggtatcttcagaaggaagtcagcagtatttccaggaagaaccagaatataatccattctctgggctgtttctagccttgggttttcacccatagggacagtgaaatggcagcttatatcaggctcttgtataccccatactatatcatgggtagttttttctgtactagtgtcctcaagttgtccacataggtttctcattctagaacatgagctcagtattctctattaacatttttgtggttaaagtcctaaattgcagtctctccagctactacataaggatacccgacctgagtgcctctgacctgacacatgaaaacaagatttggatgcccacatggacattccttcatttaacaagtatttgttgagtgcctactatgcaccagatactgggagtataataataaacaagagaccctgtgttctgggagttgatagtctaaggggaaaagggacactgacaagcagccagggcttgcaatacagtctatgcacaatactctgtactgtgatggggcattagagggggccacagagactctactttagaccagtagggtcaggaaaggcttactggagaaatgatgtccatgctgagacatcccattagacaacgtgaagggaaacggaaaacaaggcatgctccaggcatataagctaggcaactgcatgtgccaagacctgaagttgagagacagtgtggcctgttaagggaaaatgagaagagcaggacaagtccaagtatgggcccagcccagttcagcccatctatacatgtgttaccaaggaagagaccagaaatttgggggcacagctcaggatcagcccccacctgatactccattctcacctcaattgtggatgtgaagtttcagcttcaccagggctgcaaggccaaatggtccttgaacccccaagcccagcagctcagaatctcccaggcttcatgacgtaaggaagagtaagaggaaagttgcagccatgacccgagacccttctttgccctgcctggtttcctgctctgtggtggcttcatctcagcaagaaggttgccatcttgaatgggaatggacattggggtgggatggggtgggtgttggggagggagacccaaacacctgtccaatacagtcaaagaagctggttgtcaccatgtgatcaaaaaaagagacaattggctgaatttcagtcacattttctggaggtttgtagacgtcgtagaggtttacaagcctccacaataggtagaggtatccgtctggggcaggtgccccagacagcctcctggaagtgattactccactcaacagccaagaggcatctcctaaggaatgtgtgttgtttcaacctgggattggaagaagggcaaagttcttgaacaatatttcatggtttacaaacatcttgaggtttactgagcacttgtgcaccaggcttctgctaggtattttaatatctagcatgaagttggcttctcatgacagccctacaggataagtaatatatcccagctttcagatcaggaaattgaggcccagggaggtgtaagaaacttgctcaaaatccaccttgttgagtgacagaaggagaatttaaatcctgacctcctgcttcctctcacttccatccctgcattatcttatgtcaccatctcgagagccatggtaaggttggcaatattagtagtttcagataaaaaaaagcaaggcttggataggtggcagaaggtaccagaaacaggtgtttccagctgataaggttgggcccgtcagcacattttctgaggcagctccccttgctgagcaccacctcccacaatttcattccaacattttaatgaaaaataaacgtctgtccacccctaccctgtgcactaggccagatcaagcaattacacagtgtttgtgtgggaagaggactggttctgagagaccaagctgatagggaggggtgatagcagagaaaacccagctggctcagttgggtcttcccaggacccctcgtgcccttctcccactgccctttccactcagaaacctgcccccactgcccatcctgcctgggtgaggcaggatccaccaccagggtccaggcaggaccctggaactaaggattttacatgctttccaacccaactctaacacaaggccatacagcatagtggtgaagggcactactcactcactctgaacttggacagtggctccatctcttagaacctgtgttgtcttctgtgagatgaggatgatagtagcacccagcacacagggttaaatgaaaagagagtcttgccagggacagttacatgacaagtgctcaggaaacactagtcacttgtctccatttttgctttttattgaagtataatgaacataccagaaaatgcataagtgcatagctcactgttttggacaaattgaacacacctgtggaagcagcacccaattcaagaaacagaattctcagcactacaccccgactataccttctggttactatttcctcccaagaataaccccatccttacttcttacagcatagataaatttcacctgtattaaagatggtactacttgagcaaagacatggaatcaacccagatgcccatcaatgataaactggataaagaaaatatggtacatatactccaggaataccaggcagccataaaaaggaatgaaatcatgttttttgcagcaacatgaagttggaggctataatattaagcaaattaatgcaggaacagaaaaccaaataccacatgtcctcacttataagtggaagctaaacattaagcacatacagacatattataaatatgagaacaatagacattgtggactactagagggtggagggagcaggggggatggggaatttttataagtatttattggatactctgctcactacctgggtgacgagatttgtactccaaacctcagcatcccacaatatccccagataacaaatctacacatgtatcctctatatctaaaataaaagttgatttttaaaaaaagatgctaccatttgttttgttaactataatttaaaatgcaccaggaatatgcacacattctttgggtgtgttaccttatttagtcttcatcgcagccctctgatgtaggtatactcacattatccccatgtcatagatgaagaaacagggaacattctatggaatctgcaaaaatgcaggtagaactgcaagtaagtttagcaagatcacagcatacaaagtcaaaatacagaaatcagttgcatttctaaatactagcaacagaccattaaaaattgaaatttaaaatattatttacaaaatatttatacatacattttaaaaccatgaaatacttagggataaatttaacaaaatatatataaaaactacacaatcaaaattataaggcatagctaaaagaaaattttagaagatttaaataagtgaaagtatatactgtattcatgggttggaagactcaagattgttaaaatataaatttattcctaactaacctataattttagggtaatcccaatcaaaactccagcagacttttaaaagtaaattgaaaaattgattctaaaatgtgtgtaaaaaaacaaaggccctagaagagccaaaacaattttgcaaaagaagaacattttgaggactttcaacacctggtttcaagacttccagtaaagctactggaatctaggcagtggtattggcataagaatagaaaagctgggtgcagtagcacaggtctgtaatcccagctactcaagaggctgaagtggaagcgtcacttgagcccaggagtttgcgaccagcctgggcaacatagcaagactccatcttgctaagaaaaaaaaagaataggcatacagatcaatgaaacacaacagagagtacagaaataaactcacacatatacggtccctttggttttagacaaatatgccaagtcatccaatgggacagggataactgtttctacaaatggtgttggaataactgaacatacatatgcataaagaataagtaaatataaaaaagaagaatcttgtcctctacctcatgcaacagataataattaattcaaataattgatcacagacttaactttaagagttaagactgtaaatgttctaaaagtaacagaagatctttacaagattgggataggcaaatatttcttatatagaacctgaaaaaaggacccattgtaaaaaaatgataaattggtcttcatcaaaatgcaaaaatgtcttctctttaaaaggcaccattaacataacaggctacatatgggaaaaaatatttacaacacatatgcttgacaagagacttatatccagagtatttaaagaactcttccaactcaatagtaaaaagaacagcctaaattttgtaagtaggcaaaatgtttctcaagatacacaaactgtcaaagttcacattaaaaaatcattagtaatcagggattggaagtaaaaagcaaaatgagatcatatggtatgtcaattaggatgactaaaattaaaaagactgacaacaaaaagcgttgacaagtaggtggagcaactggaactctcatacgctgtggtgagaaatacaaaacagtacaaccactttggaaaaaattcaggcagtttcttacaatgttaaacatatgtctactatataacctagtaatcttacttgtacctatttacccatgagaaatgaacacagatgcccatacaaacacttgtgtgcaaatgtttagcacaaatttattcatagtaaccaaacactggaaaccacacaaattcccatcaactggtgaacagacacacaagtttttgtatcatccatattaatagcatcatactcagcaataaaaagaagcaaaatactgtactgatacatgccatcacaagtataaatctgaaaaacaccttactgagcaaaatgagccagaatacaaaagaataaatctatatgattttatttataagttctagaaagactaagtttaatctaaagtaatagaagaaaaatcagtggttgcctgggtccagtggtgggagataggggtggggaatagggagggagtccctgggaagtatcacaaggagacatttaggagagatggaaatgttccatatattgattatgattgtagttagtgtgttaatgagtatatccatttgtcaaaatttattgtattggtcatttaaaatgagtgcattttgtcatgtgataattataccttaattattaataaaataatttaaaaaaaaacaaataatgaaagctattggttttattattattatttactatctcccaggaactctgctaagccctttatgtgtaccatcttattcaatcctctcaacagccctctgatctacgcacactaacatcatgcccattttacagaggagaaaacagaggctcatggaagaatgtgaaataatgtaaccaacgttccccactaataagcaatccaggattagaatttaggtagtcttaatcagcgaatatatggctttcaaagcatgggaaaatttctctgtgtacacttgagtaattatcagtacataaatgattgttactaataatgtgcttgtattgttatttgcagaggtggtacttcaagtccacccctgggaatgtcaatatcatgggcaagtggggtatctttaacttgaaggacagcccagtcagggactggagagaatgtcagcaccccagctggatcagacaaatgctatcataggcctcagccaaaagagagctgggtagggaaactgaagggaaggtgtgcacataggctaaaccatgaaggacatgagcatccaagaaacacacacacacatcaggcctggggctccaagtaagagagaaaactctgaaccccacccagggtggggctaaggttcctaacgcacttcctgtacatgtcagggtgggtcaaggattgggcagggctgggtggggttggaggccaatctgaagagcctggttgaccagtgtggctgtcttctctggcccctagtcaatctgagaccagtcactcctagcagaatgaaaagtttgcacatggctgcttctaacctcagattctccctctttttaacaccaggaaaggttttctttgaaaattcccctgcttctctgagtctgctgttatgaagggtgagatcacaccctgtagtcatgactttggtcctgaaacaattattcatcctgttctacttaagcttggtggcccgtgctcactgggtgatgagctctccccctaatccctctccccaccagttctctcatggctcactgccctgttggctttgtcaggtgcaattgcatcaggttaaggcaggggaggaggggtgagggctgggccccagcttgggaattaagaagttgagagaggccagagagagaaggaagcaaaaagatgaagacagatacagaaacactcctgttttcaaagtcttaggcataaggggcccttctcaataggttactatttataggaacatacacagagttgctgtacccagacatgtgagccccagtgatgagatttctggtccagtggaaacatctgaaagtcgttacttaaaatgttaccaagacagccacaggcaggctctgtatgtgccctcagtcaacaaaatcttccccaccctcctctaagactctaagttatgttggatccatgagaggagtcaccatgtcatcctcaaaatgccactgagaaactgtcatccaatgactgtcatggttttcccctctttatttcttctggaagagtggaagtagggggaggcagaaagtgtagtggcagaggataaggctgacagaccacagtgggtgactgaagtactaagacaatggggtggcacagaagaatgctgagcagccagtgttagaactgtgttttaggccgggcaccgtggctcacccctgtaatcccagcactttgggaggccgaggcaggcggatcacgaggtcaggagatcgagaccatcctggctaacaaggtgaaaccccatctctactaaaaataaaaattaaaaaaaaattagctggacgtggcagcaggcgcctgtagtcccagctactaagacaggagaatggcgtgaacccaggaggcggagcttgcagtgagctgagatcaggccactacactccagcctgggtgacagagtgagactccgtctcaaaaaaaaaaaaacaaaaaatactgtgttttagattaaaatgctccagcagccagagtgaggactggaccagacacagaccagggtgagagatctcaagatgggcctggggcatcagcagtgatgacggaggataggagatagatttctatggctgatatttattattttacatgtgtggctgcccattaatgtttttatttgtttgttgttttagagagagggtcttgctctgttgcccaggctgagtacagtggcatgatcacagctcactgcagcctcaaactcctgggctcaagtgatccccctgcaccagtcccccaagtagctgggaccacagacctgcaccaccacttctagcaaattttttaaattttttgtagagatgggggcctcactgtgttgcccaggcccctcttgaacaggagatcctcccacttcaccctcccaagtagctgagattacaggtccacaaagcccagcttttttttcattatctttttaacagccttttgcaatttgggggaaatagaacataatgagttccactggaaattttctgatgtagaaatcagaactcaagtgatttccagactcatttgctgctatgccatgagcacataaccagccttcatcaactagacactccagttgggaagtggtcaatttgaggaattggtctatttggagctcacgcacagttttgctggtgtaggaaacaaccaagtcaccagctttcagggcagcatgtttgccaagccaaattgccaacccagaagtgacattaatgctggtaacattgcaataaagtcagttttctggcatctagtattcagtggcagcttcagcaacagcaatcaaagtctcaacattaagctagagctgctacgtggtttcggatgttcttagaagcttggcctcaagccagtttctccgtctcctccatcaactatgggggctacttgacatattttgctaaattacttttcttcctagttttgtattctgtcatttgcaaccgagaaactggctgatacaattcttggttatttatgggtaatattaagaggatttagtgacctattagcccaactactagaacagtgactgacacatagcagacattcagtatacctcaaatacttgttgagaggcaggaaggcaggaaggcaggcaagaaggaaagggaagggaagggaagggaagggaagggaagggaagggaaggaaagggaagggaagggaagggaagggaagcaaagggaaggaaagggaagggagggaaggagggaatgagggaagggagggaggagggaagggacggagagagggaagggggaagaaaagaaggatgaagggaaggataaacagagtgtatgtaatatgagagatgaaggagtgtaggatgatatacagattagacaactttgtggatggtagtgctatcactgagacatgaaaggcagaagacagagcaggtttgagaaaatgatgagtcaggtttgggaccgctggattcaagtttcctccagtacatccaagtacagattttcagtagtttgctggatatttagatccagagttcaacaggaaactcagggcagtagatgacttgcgggtgacccagacagaggagtaagtgagttttgcaaatggaagaaatgccctagtgcaaagaagaaatgacaatgaatgaaattctgaaaagtaccagcatttaggagataacttgaggagttgctcacaaaagacactgaggaaaactgccagaagttcagctgagctttgtggacccacatgtcatcaaaggccagtggtgactggaccaggtgaaaacaagaaatctttctgcttctgtttccatttccacagtgcatgggccaaaacacttaccttcccggctccttgctgtgaatgatcatgaaaggcaggcctcttgaccaagctgcagacatttatgagcatctactgcgcgctaggcactgagcaaggcaatttacattgattgtcctttttaattctatcaattgcactatgagtgacttattatatttgtcccattattgctgaggttcaaaaaagtaaggtcactttccacttcccacagggctggctattagaatcattcagcaagagatcctgaacagggctggagggagaaggcttcaaaaagagcaaccagtttgcattacgggaaactgaggcacagagatgttactcgcctaacgtcacatggttagtgactggttctaatcccaggccagcctgccttaaggatccaatgatgataatgttgatgatgatgtgacagggatagtaacagtgatggtaacaacaacagtgactgctgctacgtttatggggtgcctataatatgccaaaattggtgcatttcatgcattgcctcacttaattctcatgacaacacaataaggtagggctatcataaacccctcttcagccatgagtgtaaaaggggctcaaattgtcactgtgagcaataataatcctactggggcttggggctggaggttggcatgcaggacaggctggaaacagactgccccacagcagatcctggcttctcagaccccgaggcagccccagggagcagacagcccagcccaacccaggcaagggagacattctgcccagacaaaccgcagaagcgtctggggcgctgctgtctcctgtcctctacaaacttgtagcagcttgcgtgtgcagatctctgggatgagatgatcaaggactggcccccctgtcccaagtgctcatgaggaaactgccctgtgtgccatagggctcatctctccaggcctgcccagacccaggaccttgaactgaaccatgcacaggtctataggttgaggaggtggatagaaaagggtccccagatagcagaccctggtgggaattttagcgccaccataagcctttgttctaagcttcctttcatctggcttccagaactaggacctgctggatggtttattgcctttccttttaagtcacattaaaaataacttttcagtaatcaccctaacacaaggtacttgactcgctggggatccccagtgcctagaaagatgcttggtatgtactagaaataacaaatatttattgagcacttactatgtgataggcaaggcaccatgaactttacattctttatctatcacctttaatgctcactacaaccctatgaaatatattctcttattatctccattttacagatgagaaaactgagactttgaaaggtgaagtgacttagctcaaggtcacataatgaaaaagcagcagagctaggatttgactgcagtctatgctcagacagtcccaccatgatactgtgttgtataaaataggtgaaagagtgtgtgtgtgtgtgtgtgggtgtgtttagaaaggcagcctaatttggtggagatatttagtagagacatttaggaaccttgggctccaagcttaattctgctatatgaaagctgtgttacctcgatgaaagaacttgacgtctctgagattcagtgtcctcatccttcttttcaaacctccagttgtggaagacaaactatggctctgaaataacaagcacaaatgcaatagaaatacaaagcatgagtgagtatacatagacacttgtgtggcccatgtgtgtctgtgtatgtggcagctccctgggcaggtctgtgcatttgtgtgtaaatgcttttacacgtgagcatgcgtagcagaatcatgtctgtttcctctcttgagagcccctggttatgcactgtgggtccggaaaaggtatccagacctcactcattatacccatttgcctgttgtacttagaaactttattttctaccgaagttatggctccctcccagctgttgaaagtctgggttatggcatgagtggaagatcaaggctgcttccactcccaaatgcatgctcagtccctcgctctgcccatttgtcaactcttggcccaaaactgtcctctcagagatttcccttaggctgagtaaggaagccagttatagccacctgggaaaaaggagcctcagacaatgtggaggggccaggggagaggatacctgctccaggtcttattttcctctctcaatacctaagcaaacgcgccgtgacaaaggaggggactttggcttttccacatagagtgagtgctacataaatataaattaaagacatcaacaaccatcaatagtcacttttataagacccattttacagataagagaactgaggttcaaaatgtttaagtaattgacacaaggtcacagggcacataagcagcaaagacaggatcctggagcagctccatcctacaccaaaacctgcgcttattccactgtgcccacgaaggtatcaaactggtgcacctggcaaggtcataggtgaggcagctgggatttcccaatctgccttaacacatagccttagccagggtgactgagcaagaaagcactgtctctgcctgaaattgtgccagggaaagggtgcagactcaagagaccagcttagcagttgtgtaaggggtatcatcctgcctgcacactgtttccttatctgcaaattggtctagcacgccacacctctcaggatcagtggagaccagaagagtgtggggagatcagcacatacaggtgtgtggaccagagatgaagacccatgaacatcaggcagtggggatagaaagaaggcagaggccaggtcctgaaggtctagtgaagccatctgtattagtttcctgaacttggcagcctaaaacaacaaacatttattatttctcagctttagaggccagaaatccaaaacgagtttcagtgggccaatatcaaggtgttggcagggctgtgctccctctggaggctctagaggagaatctgttccttgccttttccagcttctgggggctgccagcttcccttgatctcagttgcattgttccagtatctgcccccgtgatcactttgcttctcagtctgtgtgtggtaaaacctccttctgtctccctcttataaagagacatgtgatggtatttagggcacacctgtataagccaggataatctacccaccttaaaatcctcaacttaatcacatctgcaaacagtctttttccaaaagaaaaaataaaggaatatttacagggattaggaacaattatctttcgggggcattttcagcctactacaccatctaaataagctgatactacatcttggtggcaccaaggagccattggaaggtctctggtggcagagtgccatgatgagatctatttcctgaaataaatgtggactctctcatggcctgtggcaaatccactccctgctcgaggtttctgaaaagtcccagaggctttcactattttgtcactcctagctccctttctttccctcttacctatgatctcctgcacttctgctcaaatgcagaattaaaatattcttccttgatctttaccccctccccccaaaaaaattcactcacacaagacatttttgtgtgtcgatgactttactaaaggtttgtaatgtcagactgagttgacatcatagaatgcaaacaattttaaattaagcattaaatatctcattttgatgcatccttgacccaccctggctaccttctttctagactttccccttctaccatgttcccagactgcttattttcattctttttttattattttccttttctctgctctaccccatccggaaattcctgcaatttctcagactgagcagttaagatatgtcttaccctctccaggtgataaatgttaatttctggcctctaaagctgagagaggtgttaatttcctaagcaagggtaacttcctccccaagaggatccctaatactgcagttgaaatcagaattttttcatcctattgcacttatacatagaagtatattatatgttaaatacatttaaagggacatcgcacatgtaaatacccacacactctcatacacacacatgccccaaagatcacagctaagtcccaacttgaagtaagcatgttcgaatgtcatcgccatgacccacccacccatctgttttgagctgtggttggcagcaaataattagcattcaccaggatggccaagcccagcttccactgtggatcccaacagcctgcctcacagcaagagactccgctttggtgtaattacctattccttgcacaccagttgccctggtgtgatgtcagcccctccacattgtttattttaattaaaacagaaattgcaggtcttaggtgcttgtaattacagcccatgaactaaattgactgaggcccctaattaacctgaaacacgtctacctggctggaggtgtgagtttggacttgactagttcagggcactgcatcggcaccaaaaacagagcaaggaaaggtctattagggattcagatagggcatttgccctccaaaaactgctacacacagcctgtacccctcagaccacattgtgggttcaatttcaattccaaatgtacctaattagcccaggacacactcagcaaaagtgtagtgatagcatctaaaaatcaactaatgtaatcatcaatagaatagaaagcaaaaacaaaggagtaaaaaaataaaaataaaaaatcacatgatcattccaatagatgcagaaaaaaacttttgacaaaatccaacactctttttttaataaaaacactcaacaaactagggatagaagagaacttcctcaacctgataaagagcatctatgagaaacccatagctacgtcatactcagtggtgagaaactttctccctaaggagatgctttctccctaagatcaggaacatgacaaggatgtctgcccttaacacttcaattcagcattgttctggaggttctgtcgcaggcaattgaaaaagaaaaagaaatacagacattcagcttggaaagaaagaagtaaaactatctctatttttatgtgacatgatctcatatatataaaatccgaaggaatccactaaaaaatagaactaataaatgaattcaacaaggttgcaggatacaagatcaatctacaaaaatcaactgtatttctatacacttgcaatgagaaatctaaaaataaagttaagaaaataatttaatatgcaatggttggtgggactgtaaactagttcaaccattgtggaagtcagtgtggcaattcctcagggatctagaactggaaataccatttgacccagccatcccattactgggtatatacccaaaggactataaatcatgctgctataaagacacatgcacacttatgtttattgtggcactattcacaaaagcaaagacttggaatcaacccaaatgtccaacaatgatagactggattaagcaaatgtggcacatatacaccatggaatactatgcagccataaaaaatgatgagttcatgtcctttgtagggacatggatgaaattggaaatcatcattctcagtaaactatagcaagaacagaaaaccaaacaccacatattctcactcatagtgggaattgaacaatgagaacacatggacacaggaaggggaacatcacactctggggactgttgtggggttgggggagggttgtggggtggggggagggggagggatagcattaggaggtatacctaatgctaaatgacgagttaatgggtgcagcacaccaacatggcacatgtatacatatgtaactaacctgcacattgtgcacatgtaccctaaaacttaaagtataataataataaaatttaaaaaaaacaaagtagtaaaatagaaagtaatttaacaaaaaatataaaacttaactctgaaaacttcaaaacgttgttgaaagaaatttaaaaagacctataaaactctaaaaacattcgaggttcatggattgggaaacttaatattgttaagatggcaatattcctcaaattgatctacaaatttaacacaatccctatcagaatcccagcttgcttctttgtagaaattgaaactgattataaaattcatatgtaatttcaaaggtctcagaatagtcaaaatcatcttgaagaaaacaaagttttcccaaatgcccatcaattatagactggataaagaaaatgtggtacatatacaccatggaatactacattgccataaaaaggaatgagatcatgtcctttgcagggatgtagatgaagctggaagccatcatcctcagcaaactaacacaggaacagaaaaccaaacaccgcatgttctcactcataaatgggagttgaacaatgagaacacatggacacaaggaggggaacagcacacaccagggcctattagggggtgggagataaggggagggaacttagaggatgggtcaataggtgcaacaaaccaccatggcacacgtatacctacgtaacaaacctccacgttctgcacacgtatcccagaacttaaagtaaaatttaaaacaaaactgcatgttctgcacatgtaccccagaacttaaagtataataaaaaataaaatttaagaaaaagaaaagaaacaaaaatgaaaaggcaacccacagaatgaaagaagatatattcaaatgctgtctctgatgagagacttgttctagaacatgtaaagagctcttaaaactgggtaataaaaagacaaataacccaatttaaagataggcaaaggatttggattggcctttatccaaagaagatatacaaatagccaataaacacataaaaagatgctcaaccattaagcagggaaatgcaaatcaaaaccacaatgggataccacttcacgacaacaaaattgcctagataggattgcctagatagcaacaaaatcagaaagaacaaaacatcagtgttggagctatgcagaaattgcaactctcatacactgctgatggaatataaaatggtgaaaccgctttgggaaacagcctgaaagttcctcaaaaagttcaacacagagttaccatatgacccagcaatttcactcacagtagataaccaagaaaaatgaatacatacgtcacataaaaaactttcacacaagtgtttatgtaattactcataataataaattatattatgaattaattagtcaaaaagtagaaataacccaaatattaatataaatcaacttattatagacaatatatggtatatccatacactggaataaaattcagccacaatgaatgaaatgttgatatatcctaccacatagatgaactttgaaaaagttaaagtacatgaaagaagacagtcacaaaatatcacgtattatataattatacttaaatgtaatggccagaataggtaaatctatagagataggaagtagattagtgcttgcttagggctggggaagatagcggggtaggggagtgattgataaaggatgcagagtttctttgtgaagtgaggaatatattctaaaattgactgtaatgatagctgaacatatctgtaactatactaaaaaccattgaattgtactctttaaatgaatgaattttatgatatgtaaattatatctcaatgaagctgctttactaagtgtactgggtaccaagtacctcccaggcaccatacaggtgctgatataaaagccatgtcaaatacataaactgagtgtcttctttgttttttaaatgattcttcctcaatttttagaaaattaagaaaaactataaggaagaaaagagaaatcatctataatcatacctccagtgacagccattatttatatttttcatgcattttctctgtttcttccattcaaaatccttttaatgtattggatgccattttgaacatcttaaaatatatttatattaacaaacccttacatgcttaccaagcaatttaaggaataaaacaacatcaatagaagaaaacaccatctacatgcataattatcttgaggaaataatcagaggttatccaagatgtataggatgctcaccccagcaccacccttaacggtaaaacaaggaaaacactggctgggtgcagtggctcacacctgtaaatcccagcactctgggaggccaatggggggtggattacctgaagtcaggagtttgagaccagcctgaccaacatggtgaaaccccatctctactaaaaatacaaacattagccaggtgtggtggcaggtgcctgtaatcccagctacttgggaggctgaggtgggagaatcgcttgaacccagcaggtggagattgcagtgagccgagatcaccccactgcactccagcctgggtgagagagcgagacttcatctccaagggaaacacaaacttaacaaaactatctcagcgaaggtttttttttttttcatctttgtgaatgtaaaaaaaaaaaagtatctttcatttttaatgtaaagtttttgataataatgagatatttttacaaatgtattatcttttgatgcctcagcaaattatatgtgcaagtcttatgggcactttttctctggttttcttttttatatggtgattttttaaaatctctgcacgtattaaggacagtaaccattctgccgtatatattgtaagtacttttccaatttggacatttttcttttactgttgcttataatatttttaaagatatggatttttttttcagtggccaaatatattattcttatccttaagatctcttctattgctctgaggcttaaaatatctttcatcatctgaaactcaattaaatatttattatatattattctagtatttcatactggcaatcttaacttttcactatgctgtgttaagtaaaatttgtgtatatcataactgcccaaagcaataactgcctgtattttaaaaagtaactctttaatccatttataatttaatttaggagataatgtgaggtaaggttctcattttattttattccaacactcattaaaaaattcacccctttccaaataattaacatttcttttatcttctattaagcttataggtattctagcatgcaattcaagactatcccttctatttcatgacatcatattttaattgttgtataatgccatattgtttcaactacagtagtatatatgtcaaatacataagaatgacatttttacttctgttgcaggaggcaatgcttgttttgtctaatgaaattcagaatcactttcaaaatcaaaattccaaaccatgttaaatgtatgaatgaatgagggactaattaatatctttgcaatatacaatctttccaactagatatatagttgtctttctattcattctttttttatatttctaagttgaagtttcagatctgattttggtttctttccaatatgttataataaagtttcaggtatacaaaaaagttgaaagaattttatagtgagcacttacacagattatctcattgacaccttaattcctttatctcaatccatcttgagatttttatacactttaaattatgtatatatatacacatgtatgtgtatatgtgtgtgtgtgtgtatatatatatatcagtacatatcctcttaaatatttcagaatacatatcattaactgcagttcagtatttgtttacaggtttttgtggtaaaatttacacacaatgaaagacaaaaatcttaactatatattggctgagttttgacaaatgcttacatctatgtacccaaacctccatcaagatgtaaacattgcatcattccaggaaattccctcatgtccctttttcatcaataaccatttcttcccccagagtaaatcactattctgtttttctccaccatgaattagttttgcctattttagaacaacatattatggaataccgttcccatgtgtactcttgtagatgacttctttcacatgacaaaaccttttgagattcctctgtgctgttgcatgttcaataatttgttcctttctattcctaagtagtattccattgcatgaatatactgtaatgtgtttattcattctcctattgatagacacctgggctgtttccagtttataattattattattatatactaataaggtcttgctaggaacatacttgtacaaacctttttgtaggcatatattttcagttttcttggttaattacctgggattcaaatttctgggtcacagggtagatatgtgttcagatttatgaaaaattatgagacattttgccaaacgcccactaacaatgtatgacagttccagttgctccacattcttgacaattgggattgtttccatctttcattttagaacttctgaagggtgaataaggatgtcacattgtggtttgaattttcctgataagtaatgatattgagtatttttatatctggtcattggccaggtgtatatattttgtgaaatgcctgtccagttaatttgctcatttttactcctttattattaaattgcaggagttctttatacatcctggataccagtctattgtcagataacatctgttttacttataattttatccagtttgtagattgcctacctaacagtgtctatctatgagcagaagttttcttaataacgtctatttatgagcagaagtttcaagctttgatgaagtctaatttatcagtttttctgagtcttgtcaaagaaaacttagtctatccctaagtcataaagatactatcctatatttctattgaaaactgtgtggtttgtatattgtataaagtggcagttaaagtcctttttctcacgagaataactggctattgcagcatccttagttagaagacttttctttctgtattgaattgctttgatgattctatcaaaaattagttggccagtggagtgtgtttatgagctttctgttctgttccactaatcatttgttgatggttatgccagtaccacattgtcttaattgctttagctttaaaatgagtcttgaaatcagatagtataagttgactaactgttcttctttatcaagattgttttatcaaagtattctatgtgcttgcatttatatataaatagtagagtcatttttttcagtttctgcaaaagtctttctattgtgattatgttgaatctattggtcggttgggagaggattaacatcttgacaacattatatcttcgtatccataaccacccattgatttgggtcttctttatttactctcagcaatgttttatagttttcagtgtagaggtcttgtacatatactgttaaatctaatccccagtattttttgtttttgataatctgtaaagggtttcttaaaattttacttcccaaacatttgttgctagtatataaataataaaattgatttgtgtatgtttaccttgaatcttacgagctctctaaattcacggattacttctagtagttgtttcatagatttattaagattttatatgtaaacaatcatgacaccagcaaataagtacaattttacctcttcctatctgtatgcattttttttatttttggtttttctccttttgcaatggctgcaatcgcagtacaatgttaaatagaatggtgagagagggcatctttgccttgtttccaatcttagtgagaaagtgttcaatatttcaccaataagtatgatgtttgatgtatctttttaataaataatctttatcgattgagaagtttctcttttattactagatggttttattgctagattaatgactagattgtttttatcaatgggatgttcattttctgtcaagtctcttttctccttgatgcatgtttcttcctagttctgttaatgcagtggattatactgttggatttttaagtgttaaatgaactttatatttctgagataattctgacataataaaaaagtcagaatgtgtcattcttttcatatacactactggattgggtttgctaatattttgttaagggtttttgaggctctgttcatccaggactttttgtcagtaattctttctatcttcctttaattttttggaacaagaggaaatatctgtcagatttgggcattatagtttcataaatgagggtcatgaaatgaattagggagtgtttcttcctcctctcttttctgaaaagagtttgtaaacgatgttatttcttcttaaatattgagagaattcacttgtgaaaatattgagacctagaattttctttgagggaagatgtttattaacttctttgactccacatttacttggagaatttggtatgtgtttatttgtgtgttggggaagggggttattttaaaccctattattcttttttattctttttttttttcagctttttatctaatggagctctgctctactgaggtggaatcgcttccaaattttcttgccttattctttaacattcaaaatcagcagaacatatgaaagtctacagtgtccagcaggccctgctgctcagtctgtccttgtctctgtcctcatcacacaactttacttatagtatctattcctcccaggatccatgtattaaggtcacaactttctaccctgtcattttacaaaacatatgatcttcaacaaatatattgaggatggcaagatttggctgccttaaaaagcaactcacagacttgagagatggccatccaattttttaattgctgcagatgctatgtctctgagccaatgcaaagagagggagagggaaagagcgtctccacttttacgatggcagggctgcactgtttctgtgtcttcattagagaggttaattggaaatcaagagaggctgtgtcacgggcagcaatagctagccagatgccattttaaactggaatttatccagctgatttctttgaaaatctaccatgctttgctcaatagacacactgctggctggcaccaaggaaatgactggtacgtaagcacacattcagcatttagtagttcatttttcccttccttctgctccttcagctgatcatgtcctcaattatactcagaaatgagggattcccttcatgaatcagtaagggttgagagcaatggctaagagttccgactgagtcttcctcaacttatctgcattcctggttactgcaaagtttttataagatcctggaaataccaggctatttgaacccattcagttatctctggctcatgcacctcatccatcagcaaattaaaacttggatgtgagatgtcagtgaaggaaagagaagcatggtcccttaactgctacaaataatatgcaagtgagctagcagaggtatgtcataaaagggatgaggggcaaaaaggatctccctctaggcctaggaacattctgaatttgatgctttcctgtggattataatcccacaagacacaatgccaaatgccataacccaaatgttgaaatccctgacatccacatttctaaagtctaaaattcctaaggtctaaaatcccaaaaatcacaaacacaggatagttgcatcaggttagggagaacgattactctgttagtgtctttgtttggaagttaagtatggtttaaggagatgcatatgggtgccaagttgacaagaggtggacttgtgaatttaattttaggtgtcaccttgactagattaaggagtccctagaaacctgataaagcattattttgggagtgtctgtgaggttgtttccagatgagatgagtgtgagtctgagtgaactccgtagggaagatctgccctcaaccttgtcaggcaccctccaatcagccagggcacagaaggcgaatcaatttctctctgagagctggggcagactctcttctgctgctttggacatcagtactccaggcttgctggcctttggacttcagttgttatacctacagccccgcaggtagtgaagctttcggttcttgactgatagaccataagcttctctggttctcaacataaaaacattgaaatttcctctgtagtgtaagagatgttatttttgttcgttttcgtttttgaaagctaaaatttattgagatctcagctctttgcaagactgcatatgcagtggtgacccattgagggttttggtcagtctcatcaaaatacaggttgtctgacacgatatttcaagtgaccacagttataaagccgggtgcagccaattaccaaccatgatgatatgcattcatacatttcgctttttgacctatttctttatgaatacatttgtctgatcataactgttacactcctgtaaatgtttttagtatacctgggtgtttatgcttataaaaaatgtatgttattattccctatttcattgtgtaaactggcctaggaagtgttctgtcatgtttttatatgtttctcaggaaaacccattttaacatgtaaataaatgttttttaaagaatattttattattttttccagaatcatattttcaggattttgatcttttgggatttcaacatttgcaattacggcattaagattgtatcttccaggattaggatcagcttctgaatacttacagtctaatgccaaggaagaaagctaatggccaaaatatttaaatagcttagtcttttgatgaacaactaactcagctatttgagttgctaatgtcaaagcaaagacaaaattcccaggaataatgttccagagcaaacttgctcaatttttaaatgcgttttaacaatgatcatgtattgacagaatagaacaaggattttttaaaattgatctgcagaaaaaaatggcttatctatacctgtcatgtctaacatggtaacaactagccacatggggctattaacccatgtgaaatgtggctaatccaaattaatatgtgctgtaagtatataacacacaccagatacaagtacaaagacaaagacatagtatgaaaaaaggaacgtattttactaataatgtctctgagaagttgcatgttaaaataatcatattttagatttattggattaaagaaaatgtgttattaaaattaattttacctctgtttttacttgtttaatgtggttcctagaaaattttaaattacatatgtggctcatagtagatttctattagacagctctaaacaattaaaataatggcatactggaaaaagttcttgtgcatgtatattagttcaccagggctgccatagcaaagtaccacagattgacataaataatagaaatgtatttctcacagttctgggggctggagtctgaggtcacggtgttggcagggttggtttcttctgaggcttctctccttggcttgcagatggccacctcctccctgtgccttcacatggtcttcagcacctgtctgcatctgaatttcccattcctataaggaggacatcagtcaggggaggagccaagatggctgaataggaacagctccggtctacagctcccagcgtgagcgacgcagaagacgggtgatttctgcatttccatctgaggtaccgggttcatctcactagggagtgccagacagtgggcgcaggtcagtgggtgcgcgcaccgtgcgcgagccgaagcagggtgaggcattgcctcactcgggaagcgcaaggggtcagggagttccctttcctagtcaaagaaaggggtgacggacggcacctggaaaatcgggtcactcccacccgaatactgcgcttttccgacgggcttaaaaaacggcgcgccacgagattatatcccacacctggctcggagggttctacgcccacggagtctcactgattgctagcacagcagtctgagatcaaactgcaaagcggcagcgaggctgggggaggggcgcccgccattgcccaggcttgcttaggtaagcgaagcagccaggaagctcgaactgggtggagcccaccacaactcaaggaggcctgcctgcctctgtaggctccacctctgggggcagggcacagacaaacaaaaagacagcagtaacctctgcagacttaaatgtccctgtctgacagctttgaagagagcagtggttctcccagtacgcagctggagagcagctggagatctgagaacgggcagactgcctcctcaaatgagtccctgacccctgacccccgagcagcctaactgggaggcacccccctgcaggggcacactgacacctcacacggcagggtactccaacacacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgcctctcctcctccaaaggaacgcagttcctcaccagcaatggaacaaagctggacggagaacgactttgacgagctgagagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgctgcgatcaactggaagaaagggtatcagcgatggaagatgaaatgaatgaaatgaagcaagaagggaagtttagagaaaaaagaataaaaagaaatgagcaaagcctccaagaaatatgggactatgtgaaaagaccaaatctacgtctgattggtgtacctgaaagtgacggggagaatggaaccaagttggaaaacactctgcaggatattatccaggagaacttccccaatctagcaaggcaggccaacgttaagattcaggaaatacagagaactccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaaattcatatccagccaaactaagcttcataagtgaaggagaaataaaatactttacagacaagcaaatgctgagagattttgtcaccaccaggcctgccctaaaagagctcctgaaggaagtgctaaacatggaaaggaacaactggtaccagctgctgcaaaatcatgccaaaatgtaaagaccatcgagactaggaagaaactgcatcaactaacgagcaaaataaccagctaacatcataatgacaggatcaaattcacacataacaatattaactttaaatgtaaatggactaaatgctccaattaaaagacacagactggcaaattggataaagagtcaagatccatcagtgtgctgtattcaggaaacccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggcaattacataatggtaaagggatcaattcaacaagaagagctaactatcctaaatatatatacacccaatacaggagcacccagattcataaagcaagtcctgagtgacctacaaagacacttagactcccacacattaataataggagactttaacaccccactgtcaacattagacagatcaacaagacagaaagtcaacaaggatacccaggaattgaactcagctctgcaccaagcggacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctcccagaccccagtgcaatcaaactagaactcaagattcagaatctcactcaaaaccgctcaactacatggaaactgaacaacctgctcctgaatgactactgggtacataacgaaatgaaggcagaaataaagatgttcttcgaaaccaacgagaacaaagacacaacataccagaatctctgggacgcattcaaagcagtgtgtacagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaatagatagaccactagcaagactaataaagaaaaaaagagagaagaatcaaatagacacaataaaaaatgataaaggggatatcaccactgatcccacacaaatacaaactaccatcagagaatactacaaacacctctacgcaaataaactagaaaatctagaagaaatggataaattcctggacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccatttcttctgaaactattccaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaacgaatccagcagcacatcaaaaagcttatacaccatgatcaagtgggcttcatccctgggatgcaagactggttcaatatacgcaaatcaataaatgtaatccagcatataaacagagccaaagacaaaaaccacatgattatctcaatagatgcagaaaaggcctttgacaaaattcaacaacccttcatgctaaaaactctcaataaatgaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagcgtattcaattaggaaaagaggaagtcaaattgtccctgtttgcagacgacatgattgtatatctagaaaaccccattgtctcagcccaaaatctccttaagctgataagcaacttcagcaaagcctcaggatacaaaaccaatgtacaaaaatcacaagcattcttatacaccaacaacagacaaacagagagccaaatcatgagtgaactcccattcacaattgcttcaaagaataaaatacctaggaatccaacttacaagggatgtgaaggacctcttcaaggagaactacaaaccactgctcaatgaaatagaagaggatacaaacaaatggaagaacattccatgctcatgggtaggaagaatcaatatcgtgaaaatggccatactgcccaaggtaatttacagattcaatgccatccccatcgagctaccaatgcctttcttcacagatttggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattacctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcaataccattcaggacataggcatgggcaaggacttcatgtctaaaacaccaaaagcaatggcaacataagacaaaattgacaaatgggatctaattaaactaaagagcttctgtacagcaaaagaaactaccatcagagtgaacaggcaacctacaaaatgggagaaaatttttgccacctactcatctgacaaagggctaatatccagaatctacaatgaactcaaacaaatttacaagaaaaaaacaaccccatcaaaaagtgggcgaaggacatgaacagacacttctcaaaagaagatatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactattgcaagaacaaaaaaccaaacaccgcatattctcactcataggtgggaattgaacaatgagatcacatggacacaggaaggggaacatcacactctggggactgttgtggggtggggggaggggggagggatagcattgggagatatacctaatgctagatgacgagttagtgggtgcagcgcaccagcgtggcgtatgtatacatatgtaactaacctgcacaatgtgcacatgtaccctaaaacttaaagtataataataaaagaaaaaaaaaaaaagaaggacatcagtcatattggatgaaggcccacaggaaagaaaggcctcatttaatcttaattacctctttaaaaatcctatctccaaaagcgattacgttctgaggtactaggggtttagggttgcaagaacaggaatttggggggatacaagtcagcccataacagcatgacattgtcctgggtttggaacttgtgttcagtatttactagctatatgatcctcagaaagaaatgtcccttctctttacccaaaatttattaccattaaaacagggataatttattatatttcatgatatgtatgtgggtatatgtatataatattttatcttaagcatttcgtcaagttattaggtatctcactataatataaataagaagtttgagggctgcatttttccacttctgccactataccaacatgtatttaaccaatccactcttagagtatatcaaattgtttctaactttctactaactttctactctaactttctactcttacttgtagtaagtcacaagtcagttgagtcagtgtcagcaaagtcatgcttcctccagaggtttagtgtaggatcctgcctaggctcttccagcttctggtggctcctgacattccttggctggtagcagtgtcactccaatgcctgcctctgtcttcacatggtcttcttccttgggtctctttgcatcttctccttttctgtctcttagaaggacacctgtgattggatttagggcccaccctaatccaggatgatctcacctcaactgtattagtctattgttacgctgctgataaagacatacctgagactgagactgggtgatttataaagaaaaagagatttaatgggctcacagttccatgtggctgagaaggcctcacaatcatggcagaagacaaaaggcatgtcttacaaaatggcaggcaagagacagaatgagcttgtgcaggggaatttctcttcataataccatcagatctcatgaggattattcactaccatgagaatagcaaggaaacgcatgtccacatgattcaattgcctcccacacacgtgggaattgtaggagctacaattcaaaatgagatttgggtggggacacagccaaaccataacagtgctataatgaataagcttgaatgtatctttatatcattcatatctctgatatttccttagcaataaattctgagaagcagaattaactggtcaagggatatgtatcttttaagattcttttacatctgttgagaaattcaggaggtagactcccaacattaggaataaaatttcatttttccccataccatggcaagaactagggattatcttttttttaatatatttgtctatttgatgggtgaaaatgatatctttttacttaatttttatttttttcaccatttcaacaattatttaaattatttcaaaaaaaaaaagtattttaaaacaaggagagccttctgccctgctgactggatatttgaaatgttcacagagccctcgggagttttggttcttcattcaaactttcaattccatagagtttctctatcacatctcaactgacttttgtcatgctctccatatatgtagttttttaagattgccaactctatattagttgcctacagcttccacaacaacttaccccaaagttggtggcttaaaacaacagaattttattctctcataattctggaggccagcagtccaaaatcaaggtgccagcaaagttatgcttcctccaaaggttctagtgtaggatcctgccttggctcttccaacttctgatggctcctaacattccttggctggtggcagcatcatcccaatgtctgcctctgtctttacatgaccttcttccttgggtctctttgcatcttctccttttctgtcccttagaaggacacttgtcattggatttagggcccaccctaatccaggatgatctcacctcaagctccttaccttaattatagctgcaaacatctcatttccaaataaggtcacattcacaggttccaggggctaggactggacatatcccttagggaacagttttcagtccattatgcctccagagcccggctcctttgaagttccccatggagtcagttcacttccattccattagctgaatggtgagtgctactgcccccactatttggtttctcttgacacatgagaaagcaaatagtaatggctacaactaaataaaggaattgtttgtcttgtttctataatgtcatgtgaagagtttcacttttttttcatatacaatgaacatttgttgcaatgcataggacagtctactgacttagggtgagcaggggggcagagaggagcaggtgtcacatgttgaacacacaatgcccccatcaaaaacctccgttaaaaaactcagattctatgagggaaagaatgacaaaaataaaacgatttcaatataaactgaacattgatgagaaatataagccaaacatcctagggcatctaagaaaggagtgtgctattctgcctgagaaaagccaggagggaggagacactggacgtggacaaggagggatgatcattgatccatccagtggctcaggagggaagggcattccaggcagagggaacagtgtgttctaggcatagactcagaagtgtgcatgggaagtttattgaggaggtgggatgtccaacatacccagagtgcaaagcagcagtagggccatacgcagagtatcccaattagaaagtcttattgaaagaaaataagataaatttgtgaataacacaaaatgaggtacagttccgagtcccccaccaaaatgccgatctctccctcagtaaaggccagacataaaagggtactgcatgattccatttaagtgacgtttctagaacaatccaaatctatagtgattaaaaaaaaaaaaaaaagcaagttagtgcttgtctggggcaaagtgtgcagggaggttgcgtgtaaagagacaggaaggagtggtccgggtgacagaaatgttctatgctttgattgcagtgatggttacccaagtatatacatttgtcaaaactcacaaacagtccccttaggtgtgtggatttcattgtatatttatacctcaataaagatgatttttaaaaatgtaggagcaaaagggaatattcacttagaatgagaaaagaaattacaactaattataaattttgtcaataaaaagctgaatagtaccagaaacatctcagccattcagaaaaatagccattttgtgcattaatgaactgccgacctactttgataacattgtttttcctacttgttttggcttcattctctttgtctcttcccatgtcagtagtagtataacaagttttataatattaatggttgatcagtttgacttttattactgataatttagaaaatgtctctccacttcctaactctttgttcatatcctttgtattttttaaggattgtcacaaagtttggcaaaacctccatgaatttttttcgtatttgagctctggaacttgtaaggattgtccacagactagcttccagctctgtacatttcaaacttggtttctccgccatactttgggcaccacagaacacgttcacgtcgtgaaacagcctctggccccaaaccttcacttggcaacattcacacatcacatgtgagtcggcacagtaggtggtaccagtgtccttggaagcagatttcgacactgggatgattagcaattacttacccgtatatggaagcgactgcaaatcacacagctataagcccaaactaagtgtatccccaactcagtatcttcttagccagattcccaaagtccttgggaccgctctaacagtacagaagagacagaggaatggtacaaatatcagagaagaagagagagtggccttaacctatatcagtttaaatatcttattttcacaaatttggcagaaccacatggccatgggaatacattgctaggactgctagcaaggactctaaagctgaaaaacctcaggggctgctcagtgaggctgcctcagggcagtggctgccgtgggtagttttgggaaagtggtcgggaccagatttggagagctttcagtcaggtgctgaaatacagcctttaacctccaggcagaggggcttttcctttaacgaagagaacagaatcactttgtgttggtgggggaactctggcagccatggaaagggttgcttcagggtttactgtttgtttgttttagtttcttcttttaactcacagcatttcttatgcaacccccctcaaaataaaaataccttttctatttaagtgtctttaaattaagaaaactgtattaaatacattaaagataattttgaaaaaagcccagaactcccccctaccgcggccaaccaatttcaccaagctaaacttgtttaagtcacttaattatctaagtgaacaaagtggttcagaacatacactgcaaagtaaaattcctcacttcaaaatttggcaccaccgcttcctaactctgtgactctaggcaaattatctaagctctgcaacctcagtttcctcatctgtaaaacagaaaaaacaatagaagctaagtgtagagtcactgtgcagatgaaatgagctgattcactgggagcacagggcaccatttctgactcaatcaatgttagcagtgatgaatatttctgtctaccccttccccaggcagatatgttttattgagtctccacctctgcaggctctttttcatgattctttatcattatgccaaccattaaaatattcagggccaagcgaaacatttcaactaaaaacagctagttgaatgcgttgtgtggcccgtttcctgagagcacttgaggggagtcgtagggtgtcggagaaattagtcactgagaagggacacagaaagagggaagccaagacaaactgtgttagtcaggactctttgggtttcaatagaaaaaagcccaactcaaacatatttaagaataaaaaggcaagattggcagagcatggaggctcacgactgcaatcccgcactttgggaggccaaggcaggcagatcccttgaggtcaggagattgagaccagcctgcccaacatagctaaaccctgtttctactaaaaacacaaaaattagctaggcatggtggagggcgcctgtagtcccagctactcgggaggctgaggcaggagaattgcttgaatcccagaggcagaggttgcagtgagctgagatcgcacgactgcactccagcctgggccacagaatgagactctgtttcaaaaaaaatttttttaaagacagtattgtcccctacgacagaagggaaatggggtaatggtactgcatgcttatctggatcaaggagctcaaataatattgtcaggcatctccactttctctcagctttgtgtccctctgtacatttcctcattttctcctctagctatcgtgatgcagagggcagtgggcatgtccccagacaaccccaggctgacatcattgctgtttagcatcaaccaagggaagagctcgtcagcttgcctcatgtggccacagatggtaggatattgtccttggcaacctcaccagaaccctaagaagggaagggtgaggtgatattcccaagagaaagggtgaagggatgcaaaacagacagagagatgccacttgacaagggttctcatggccaaggtcagccattgcatcttcaatcacaatttccatttcaagactcatttcccacccacagggtgtgggcttcttggaggcctcaaatggtgggagtctgtcacccacatggactctgcagcaagccgccacctgcttcttcataagaggcaaactcgctcagaggcctgggctgcggctgtgggcgcccagtcaggcactgggcattcttgggcctgggcagttgctgagtcaaagggccgagggccaaggcacgggctgccctatcctgctcccctcagatgggtggtactgaatgttctccaggcgatgcagggctgctgtgctactttaattggagacggtgatggtgaaaccttcaggggaaattcaggtgccaaatgcctctcctagaggcgcattaaaagtgtctagtagttgaccaacccaaatagcaggcatctctggggaatttcccagcaggggcctcgccctatcacctcctcccacctcccagcacaggagaaagaatcctgccatccagacacacctggctctgcctccgccccttccaacctgcagattcttaagcaattttcttcacctctctaggcctcaatttccttattcataaaataggaattatactattttgtctggaataataagataatggccatagatctatttgaattgtttatttttacttaagtcagttttggcaaattatatttttcctagaagcattcccttcataaagatgtccaatgttttggtgaccaggcacagtggctcacacctgtaatcccaacactttgggaggccgaagtgggcagatcacatgaggtcaggagttcaagaccagcctgaccaacactgtaaaaccctgtctctactaacaatacaaaaattagctgggcgtggtggcacatgcctgtaatcccagctactcaggaggctgaggcaggagaattgcttgaacccgggaggcagaggttgcagtgagccaagatcacgccactgcactctagcctgggcaacagagtgagactccatctcagaaaaaaaaaaaaaaatgtatgtccaatgttttggtataaaattattcacctatcgttttgttatttgtaatgtctgtctgctgtatatgtagcgagactttccttttcatttctagctttttttgtagagtccatttgggtttgttgaacctccctaacaggccttatgtttgtattattaacttttgctcttattttgttatttccttcctatgttctaaacctttctggggtttagtctattattctgttcctatctgacagtggtagccggtaatcaaccggattggtcacacacgcagtgccctacaagttttgtcaccctatgtcacgttgtgtcccacatggtcttctttagtactcccaacgacccttagctctgaactcgtcaacagcctgtctggtcttagatccatttggcacccttcctctgacctcctgtgggatctacgctccccagggtcccttgtcctccggcatcagggtaattttaaccaatgggaagcatgtgagcaagactacaagggagaagccaggatatgtttctcccttcccctctgctcctagtgacatctctggcagtaattactgctatggtgccacacccacggggcaaaaaccaacatggtcttagcttctgccaatggccagactcctagaatctgataacaatacctcctcccattgttcctgcagccctaagggggcaggtgcagcttccggctcttactaaaatctgaattgcctctcagtgtcttcagtcatttgtgtgactaactccctgtattaaattttctttgtttgaaaaaccttgagcaattcccatttcttggctggcaattgatgaatacaaaccctttttataggtgaaccctaaagtgaggttcagagaatttaagagagaagatatagaaatatgagtactcaaccaaaaaaaagaaagaaaaaagaaatgccagtaatgaaaacaccagcacagagcctgagctcaggtctaactctgatattttctagctgtgagatcttctgagcctctgttttcccatatgcagatgtggatggtgactacacctactgcataggactgttgtgaagatgaatgcagccactatttctgacatttaactaagcaaaaagcctggcacatggccacacagctaaacattggctgaactgggatccaaatttcctatttggtgcttattaccctgtgccaagcagcctgaatcaagttgctgatgattttagttctcatgaagggacttcctgtcttaaccttgtggactggatcctttcctcagagattctccccctaagaactcccttccctcctccccccaccgtctccgccacatgaaatgatctcctctcttcccccactgaataactgcaagtggctctcaagctgatttgtcctcccaacttcccataaggaaccagatcactaggcatagctgcagggtataactcagcctcagcctccctgaaagccagcaccaaggagggctatcagagaccccaacacatggcccaaggcccctgtgcccaagagccccctgaacctgctcggaggtgtaattaagtgaactttgaaagcagccctcccactgtgggctcacaaaccccaaggaacccggtctctaatatccctgtgaaagtcagcctagccattcaccaaggaggaagagactgcagcctgtgagcgtagagtctggaatcctaccctggctttatttgggacactttgggcccaaagactctgattttggtgtctattgagtcacatctctacttccctcctttgggagaaatacgtccttgcttatcagtgctgaagcctctaccgcttactatcagtttcgaggatgaacctctgggatccaacagagacttagactcaagaagggagggttaagctggtgcaatactcacccatctaaagccagggcatcatggagtacatcctggagtagctgccttctcaatacacccccatttgggggctcctagatggtttgctctcgtaggcatgccttggcccccaaaagttagattctcagtgcatgcatgtggtcactgacatggtcattcattcattcaacaaaactgccatgattccagcatcatgtgccctctagacagaagaaacactgccccatccctgtcgggggctacacatacaaagaaacaaagcagccttgaatccacccttttatgagctgagtgattttcattatttcttgcattttagaattattttaaacattacctcctcttaggatgcccatgatgtcagaaccatggcagttttgatgaatgaatcaataataagggaatattattagaaagctaataatgtcccttaactttcagaggtacccttatgttaataatcaggtatagtcttatgtattttgtcctatatttataaaacatagatacggcttgaggtttggagaagtaggttgttttattttggttttggtttagttttttgttttgttttacgaaaatgagattatgctatataaatttcttggcaagttgcttatctcagtcatcagaccacagctatcacttcagatcaatccacttatatttgattcatttcatagctgtatcctatgtcatatcacaccatattcagtcattcccctgtaaggaagtgggaaatacatgctcacagcgttaagccattgccgttttgttgcaggatctagattaccctaatccagtggttctcaaagtgtggttcccacagaagcagcatcagcatcatctaggaaattgttagaaatgcaaatttgggggtctgtcccagaactaccacatcttaaactctggggtgggtcacggaaatctgtgttctggcgttctacaggtgattcttgaacacatgttaaagtttgagaaccactgccctaacctgtaccatgtcattcatcttccacgaggactatgtccatttgtttgccctccacaaacaattgcagcaattacagctggatgccagcttctttgcagaaaatattttctcaagctggaaaaatacaagaagtttctagataagcaaacttagatgaggacaagctagctacccagttgctaattaactcattaattcactctttcaggatgtattgaatttatagtcacaggcataatgcaaacatatgcccctgtgtaacatatttggggaaatgtgacaagcagatttttctcaaatgatctggatgcctgatgtgattcttccttaggtgcaaagaggttgcaattggtgagttctgtttgcaaaagaccaaccacctggaaatgcaagcgtggaagccatgagagtgccaaaaaatgtggaagatggaggcagagagaaccagacttgaatcctggccccacctctcacccacactccctgaacctcaagttttgcatctataaaactgtggtgataataaaacctacctatagggctgttgatccaaactgtattttgtagctcctccagggaagttttccagtcaacctaatgcttctctatggctgttcagggaatgaaaaaatgaggaaggaattaatgaattatttcatgagaatgccattttcctctgcttctttcatgttaagaattatatagagcatgtgccactgctgtcttcttcatgaaaccccctgagaggcaagggtggggtggaaggtgaggatggccatgggagtaagcagtaaagctcctgagccgtcatgagcctggctgtccattcaggagctatgaatggaatggtaactaagaggagcagggtgtttcaagcttgagcatgcattagattcccctggaagttttttaaagcacagatgactgagccccaccccagagttttcagattaagtagatctagggtggtgcctgagatttttcatctctaacacattcccagacaatgctgatgctgctggtctggggatcacactttgagaaccactgggttaggtcaatgacccaggctgatgaagtctccaccataatcaacacttggtttctaagattacactgagtgttgacatcccactggcaggagagcaaacaaatgaagaaactccaccttcttcttaagctccctggccagaaagtgatgcacattccttccactcacatgtcataggccccacctttgcaaaaggacctgggaaatttagtccttggatgggctccttcttagtaagccactttcttcccaggcatgcaaaggggtcacagatcacttagtgttgagccactgccactgccgtacatgacaagtcatcacctcatctccaaatcttgggccttgccaccaagatgtgggttagcccagccacaacctcaattcagattccgagagctaaaaatgtactgtgaacagaacatgctctggaagtcatgggagaaggggaagcaggacctatggaaagatggatacctgggcctcatcttccttagactgcttctcaatgacacaagtccatgaatgtctccactcccactgagggcacagtgtgtacagtggaaccatggacttgcagtcggatggaagagccatcactcaccagctgtgtaactttaggcctctctgcccctggtaggtattgctggttgacatagggcagcacccagattgtagctcctccacttcctgccaggcctcctcctccagcctcctcaactcctggccatgaatgtgtgcagcaatgtgacaatagccatcacttctccagcaggttactcacatcatcaaagttggggagttcgaggagataagagacctatgcagattcaatgcctccttatataatccagctcacattctgctttgcccttgccctacagttcctgtcaatccttccttccccacctgcttgttctgttgactgtaggcccagacaccgaagcaatggccccctgtagatggttgaaccagcttccacaactgcacaggatcaaaccctcataagaaagccctcagtttatgccattcttagtggttttgcttctctggctgaatcatgactgatacgggtgcttttcttccaacattctcatttaattttctgaacaactccacaagaacattcttgttagtcttattttagagatgagcaaagtgagaatcagagaggctaagtcacctgtctgagattccacagctagtgagtggtgttggggctgagacttgaacccgggcctctcaaacaccagtactttgaccactatggtattttgtgagctccttcagaagaaaactgggccccatgagatggtcaacgcaatatcaggttttcccctgtgtccatgccaggatcctgctcctctgtgcccccaacaaaggctcatccactgtgacacgggaagaggcttccttgacaagggcctgttgtctgcagagtggccactattttctctcccctgtttcccctctagctctggccagaggttcccagtgggttgattatcccatttttattacaaatcaataggaaaaggagaaaagctttctgagaagattctaagcctaattaaaaacccaggagagggctggacatgatggctcatgcctataatcccagcactttgggaggccgaggcaggcagatcacctgatgtcaggagttcaagaccaacctggccaagatggtgaaatcccgcctctactaaaaacacaaaaattagccaggcatggtggcaggtgcctataatcccagcttctagggaggctgaggcaggagaattgcttgaacccaggaagcagaggttgcagtgagccaagatcgcaccactgcactccagcctgggcggtagagcaagactccatctcaaaaaaaaacacaaacccaggagagaacatccctcaaaactattctgctcttgtgtaaagacacatatgataggagagacggtgcagaagaaagaaacaggcttccattgcgaggtgtggagacctgcccatgagagaggcaaagaaaggcagaaaagaaaacagatgaaaatggagaaaatgacagaggaaagggggagggggaaccaccaaaaacagcaagcgggaagtaacctagatataaaggagggagagaaagggaacaagacataaaatgagaaagaatcagagacaaagaaaaatagaaacagagaataaatgggagaaataggtatagaagaagagaaaaagatggatgaaagaggtgagaatagaagggagagtcagaatgagagagacagagaaagggaaagacagacagagagagagagaggtgactgccaggttcctacataattaactttctcccttggtcccaagtttttggggggagaccagagtggaacccaagacagctggtggggaagggaggcaccctggccactgcccccattgtgctggacagtggccacacttgacacagcagcaggagatagacatctgcctctgagtcagctcctttcttcacagccccacctgccccaccttttgggctaatgttgcagagttaattacagaaagcctgccagactggggatatatgagcctcaggagagcctggttctgaaggcggagggaagaggggagggagaggacggtcagggtcacctactgagctgggcactgaaggtttctactacctggaatggtccctaagcacccacaggcaaaaggtgtctgaggcccaaggaaataaggggaggtctgtcggggctaatgcctaagccacaaagccaattcttccattatggatttagacagctttcccacacttctacctatccctataactttccccagagggttttgccagtctgccatttttttctgcccctttaccacctcctctccccatctgccaatcctttctcctatctgacatctcctcctgtatctaccgtcttccatttacccacctccacccatccatctaaactttcacccaccggaagctccaaaatcccactcctcatccttctaccaactgcctacccacctgccaaacactcttccatcgattcatgtttctttataggccaacttttccacccttcctctaactccttcaacctccacagaaccttcagtcaccaccatttccactatccacatgccaatccttccatccatgaatcagcccctgtatttcccagctcctctccatctgaccttctctctatccatgcaccattctccacttatcttccaaactccttcatccatccaccaatccctccacccatctgccaacttgtccatacatttgtcaacccctcccccttcctccaactcttcacctaccatcccttctttttccaaatcctccatccaaccaccaaaatttccaacccctctctacatttacttccaccctcatcaattcctacattcacatgctaacccatcccttcagggagccatgctcccttccatttatacatacaattccatgtctaatccaccaatacctaaccccatctaccatctcattcatctgtccattcagcaacccttccattccattccaatatgtcaacctcttcctacactgtcaactcctccctccttccatccttcaatcccccaacactccaacaatctcttaatgcacccactgacttcacaaaggccccaacccagccctcagggaagttctgtaaaaagaaaatggttttgcagaactgcagagctgggatataatcttggtttggaacacactggcagcatggctcaattcagtgctccctggcctagtcacagctttgggaaggtcctcaaggccattgaggaagctggacagagtagaaagggaagtaggggaaaggttctctcacctctgttaaggacgctggtaaagttaattacagccagctcctcacccctctccacccaccccaactaactggacagtacagagggaggctcacccccctgatttctgccctgacctgttctgcctgccctaatggacacaaccaggccacagtcccctcctctgcctaaaccccggggttttgagccaactccaaagaccctgaccagccaaagccatgttgaaccaaggcctgagcagattcaccaggctgaggttgcaggtggcccccagcaccacagtggcctactcagtctatatggtcccatctcttaaataccagaaaacctcttgactacttatgagtcagtttagacccaggccaggtagattccaggtaacacagagaggtagaaactgcatcaaacctagatgtaggttatggaatcagcaagacctgggtttgtattcttcttgtacttcctggctgtgtcacttaatatctctgagccacagtgtccttgtttgtaaaatgaaggtcagaaagctcctacctactgcatgggattataattttaaaatatacatacattgggatagagcttgaaacacagtagtcccccatcgagagatgccttcacctcacttggactggctctggtggctaagtcctggtcttctctgtacatcagggaaaacaggacaaattgacattcttagaccaggttgcctgtgctgcaaaactaagccttctccccgaaaaaccccctttataagaatttccacaaaaacaaaaacgaaagcctctgttttttaggtacttttaaatgcctggaaaattttgcaatggggtaaaacttggccagaaagagaaacaaattttttttttgcaaatctcagccctaccttttggcctaggttggccccttgccaaaaatgtgagatgacaggtgaatgtgtgagtttctgtgacttgggtttccaaaatggcattcaacaagtgatctgcctaattgcttttgatatctagaaaagctaattaaggtaataatacttggcacttgtataataataaaaataatgaccctttgtatgtaaggagcatctttcatccaaggattacaaagcctttacaaacattaattaatcctcacaactcacctgtgaggtgggtgtaattagacccaatttatggctggatgaattgaggcatggatggggtgagggatgtggggaagatcacacgctgcatctgctgccaagactgggatggccctgaagattctagaagctgtactcggaattctcacatctgtctggtagaatccctctaagctgtcccaaggaacacccccatgagtcaaagttctctcttgaccagccacggagaaaagcagaacactaggacctcatctggctgggtgaccttcagctagttccttcccctctctgagcctttacttccttccccattagccaagatgactgggttccatgacacctcacctccccagtgttcagccccacaagcttgtcatcctgtttcttgcatcactggcaggttttcagggccttgaagccaccaacaaagacccaggttcagccagcatccctgggcagttaggttgccagatttagcaaagaataatacaagccactgagttagaacttttgaatttctgaaatttttgaatttcagaaaaacaatgaagaatttttcagtataagcatgtctcgtgcaatatttggaacatggttatactaaaacatggtttgttatttatctgaaattcaactttaactgggtgtcctgcgttttgtccaacaaccctgcttgttagccactctgtgccaggcacaggctgaatttctcacatctctgatctcaggtaatccttcccctactctgggaggcaggcattatcactcccattttgccacgaaaactagtctagagaagaaaagcggcctgcccagagtcctgaattcctcacctacctgggtctccctggagtctccactgacacccccagtgattgattccccagtgcccagagaccaaagtccacactccctgaggacagcccttccaggccctgcaaatctgcccctaaagtcctctctagcttcatgtcagcccaagggtcccatcacaggcatatgcaatagattcagtgtaattagtggtgcccagcacccacacttccttccgtcaggcctccaggcctttgcctctgccggtccaaccacctggaatgctgttcctccatcttctcctgcaaaatgcctgcaggtctgcaggatactgtccagtgtcacctcctcagagatgccttccctggccaaacactcgttctgctgtgttaacctctgtgctgccacattccccagcatgcttgcatgcatgtgtgtgtgtgtgtgcattcacgcgtgcatttgtgtgtgcgtgtgtgtgcatgtgtgtactgtgtgtgagtgtgtgtgtgtttgtgtgtgcgtattttctctgtgctccaccctcccatcaccagtacacctagggttgtttcttggccccatgcctcagcatacactatttcctcttcctggaatcatcctccaaaattaagtcattcattcattcaattgatacttattaagcacttgctatgtgttgagcttatccttcctgcccttatgaaatcaacagtctagtgcaggggtcagcaaatttttgtctgtaaagagacagatcgtaaatagttaggctttgcaggccatagggtctgtgtcacaactactccactctgctgttgtagtgtgggtgcagtcatagacggtattagctgggtatggctgtgttcccataaaactttatttacaaaaaaaggcagtaggccacatttggcctattgattctagttcaccaactcctggtctgttcaaaacggacattgagcaaatatcacacaaatgccggatttaacaaatttcttcaatcctgtgaaggcgaagattctactcaaactctccccactctgtgagatcttttagcagtggcctcttcctctgtgctttcagagctcctgagtttagggggctcatgtgtggtcattcaaggcagggaccacctttccaaccagatgccttaagacccactgctgatgctgcacctactcctgcctgaggtgtccctctggggccagatggggctgggctggggtggaccttgtttaggacccctccctagcagaagggaagttctgctcacccctcatccttaaagatgatcctcctgccactccttccaataacttgtctccaattataacccagggtgagccaaactgggcatcttatttaatagagagtgactgtgctcgtatatttgagttagaagcgtcacattttccttcttggcaagaaggaaacataaaaccctctccagagaccccagggccaaaagaagggacagatgtttccagcatcatggctttgtgtcccctccttcggtggttccatcttgctaggctccaaaactgtttttcaggatgtgcaccccgccccaacacacacatacatatgttaaaatcaggccccctatgcattcatacacatgtgttcagcacacaggcttacatacacctcaggtagatgtatgtttacatatataagcacacatggacacacacaaattcctgcttcacacatataccaagagtattcacaacaaggcagacaaatttgggcacaaaaacagattcatctagagacacacaaaccccgaatttttgccccacagctactatacatgtgtgcatgcacacacacactatgcacatgtatgtgcacatgcccacactatgcacatgtgagcacgcacacacatgcacacatgctatgcatgtatatacagtgaaatccaatcccgctacgtcttgcagggggaacaggccgtgaaaatcacatctttgcatttctggcctaccagttccgtctgggttcctgctgccagtctcagctccggggagggacacaggaaattcccatttccctgactgccaaatctcagccacctctgacccttagaaagacagaaactcctccagcttcctgtgagccattcctgctgtgtgcccaacactcctagccaacgtgtggcctgaggagataatgcgaggcttagtgtccagccccatgtgtggctcctgcagtcaaggcagcttccttggcctccccttggggtcagggcctggcatgctaggggcctccagggaagggccttggactgcacccaaggtcaaatgccctctttatctgaaggacgctgaccactttcctgccctgcttccctctgcttccaacatttctagcagccttggggagctcactgtccccagcagccaacgcctactactgctcttttaactcttactgagccgtctgcatccaggctctgctgccttcctagtggggagccagtggcacagatggaagtgacagtggcaggaattaagaagctggtgaaccccagctcccaggctcttggttgaactggaccgcagaatcgggaccccttgtgggtgtcctcctgttgaacaattcactcatccactcattcaaaacacttgggctgaggctctcacctggtgctggggattcagtggtgactagacaagagtcgctgaccttgctgtgggcataaaaacctgggtgccaagggaactcgtcagcatgggcttctgtagtcaggaaagcttctcagagaaagcggcatctgacttgggtctagcaggccaaagagaaatgtgcatggaagaacaagctatatgtaaccaaaagcaaatggaaagggaggctggggctgctgcatagtaggagctctgcaaatgtttgtcgactgaatgaatgaaggggaacttctggaggcttttcagtaaggaagtaatattgattattatttctaagtgatgccatctacttctcaccaaagggcttctttgcccaggatggatggatcttctcccagaggtttaattgctccatggattccctgaccccagtccccaccacacccttacatatagacacaaacacacccacaaacaagtgctggctgcagatgcccacgtgcacacagacactcacacacatgtgagacaaccacacatgtgcaaccacatgcagcccatgtccacatgtctaagaatgataatcatagcaaacacttttatccgactttcccacaggccagatggcagttctctgcatttattaactcagttaattcagccctctaaggtaggaactattgggattcccatttctacagataagaaaactaagccatggagatgagtcagttatccaaagtcatatagttaggaagtggtaggggtgggatttgatctgggccacctgatcccagagaccatgctgataatcactaaagcaaagcggtcccagtatccttctcagcctccctctcactcccagccctccacacttcaccacccatccgtggtccagacacgttgaaacccgtgggatcccccaaacacacaattcgctgccatgctcatctctctgacatgttcccttccatctctttccgaggtccacatctccttatgaggtccgttttattatttgtttaccaaacatttgttaagcacagattatggactgaggctttgtgcttagcattttacgtgcattctctcattcaaccctcactacaaccttatgaatgtcctattgttattagcctcatttcacagatgagtaaactgaggcacaaagttgttaagtcactcccgcaaggtcacaaagagggagagcttggaatggactcaaaccatcttgactcatgagcctcaactcttcatctcatcttagtctgcgtcctgctcagctttggcttctgtgactgagaacaaagtctcagagggaggaagaggagaagatggaagggaggaggaggaggaggaggaagaggagcagcattaaaacaaaactcaaggctagcggagattacgaatcctgagtgtgggtggggtggataggaggattgtagagcgaccttgtaaactttttacccacattttattgtgaatattctgaaagcatggaagagttgaaagcactgtgccatgagcgcccctaaacccactaccttgatttagcaatgagcctctcactattcttgctttatctcctgtctatgcatcttgcaagccatcgatccacttacaatgcagatactttgcagacttcttcaaatctgaagaaatggtcaaggctaagctcccttgggaaaatcactgtgggtgacgcaggttgagatttttactggggcccaagagcctgtgcacagtttacatgtacacacacagttagacgcacgtgagtgtgtgcgcgcacacacacaagggagcaaggacacaaaggatgaagacagtctcaggatttggaagagagccaggactacctcagttgatcagtccaccagttcctttccacctgccaggccccattagccccatcgaggccgccaggggccccaggggctcagggccaggctagggggtggggtatttccctaattggcctgctcgtccttcacccagcagaggaaacagccgctggcttcagcctccaaatgacaggaaacgccacggagggctactcggcagtaattactactttgagaaaggaggggaaaaaaactgagggggaacagttccaactcaaataatccactcatcggggggtggggggaatgggagggtgttccaaggaaaagacattttgaaaagccttcaatcaatctgacaagcaattatctgcttagcggctggtacaaatcccccgctgaggacttgtgccccctcccaggaagaccggagccccagactgacattcagccccccaaagcccccatgccatcctcctagtagccggaaggtgaaacgtgtagattgtaatcccgcctgggaaacttcagctctaggggcagctatggtcagagggagtggctatctgattctttccctccacacacccatatccacacacacacacatgcacacatgcacgcacactctaccctgcacgaccacatgccctgtcccacatgttgtagggtgagtttgtttcaaatattctctccttcccccagcaaccataagcattctctctcatttcattaattcattcaacaaacatttttcttgaagcttcattaggacactggtgataaggatgagagacatccctggtcttctgcatacagctggggaagaaaagtcattgtcacctgctttgtgattcctaccccagtttggggaagcagcatagagaattggagagagcatggctgggaatacaagagctgaattcagacctaagtgtgaccaggcaagctctggtcccctctagggctccagaggccaggttgagggggtctcttctttcctccatccacctgccctaggccaggcctcctcttcttaccaactctcccaggccctaggcctgcctctccctcagcaaatcccagaactgtctctagtccagcctatgtgggacagaaagagagcagacaggtttggcccaccagggagggtttgcccctgccctggacttcgtaaagagctgagaatgagcccccagcagtgcagagtggggccctgacaggcagatgtccttgcccacggtcctgcacacctcttcacacagtgcttgtgtgtatgtgcatatgtgtgtatctcacacacagcccctcactggcacattccgacatcacatgtccgcaggctgcacacatgtgggcttaatgccacaagtgagagtcctgcatccctccctggtctcactcatgggcacacagggtgtcacacctgcacattcaccaccatagatatccgtgctcctccccatgccggcacagactcacacatacacacgcacaaacagccagatatcagccatggatacaaccctcacagtcacaggcactcacacgaatttctcaccccttcacacacccagagtctcatgatggagacagcacatgggaatggagcaggcagggaatggagcgggcagggaatgaagcaggcagcagaggaaagccctcccagacagagtcctcaacagcaccaaagaaggaagccctcatccaagatgcaagtgaggagagaaggcgaaaaggacttccaggccagaggctacagcaagagggagctgaccgggacagggcaaggaaggtcagaaccctggccaggaagcagcctgggttcacagttaggagagcagagatctcagggaacagcagagtggcaggcctcgtggaatgatgatgcctgcccaccaacaccatactgtcctgaacagaaacacacacatgcaggctctctgtcaacctgcaaggcacgagggccgtcactagtcaaaacatgcttcagggtgaggaggtctgctccagctctgttgcaaatggagggagtttctgctttcatgcagtgcagtcaggggatgggagttgggtttagcttggggctaatcttgtacctgagttcttctggtcataaaacatgagggtgtgtctttttggggacatggtgagccatgtgcctgctttccagtgcatcagatatgtcttgccaatctctgagggcaaaatgaaatgtcttgggagagcaaacagccgcctccctcctgtgccaggagagcagaatcattttgctctgtctacacaagcattcctgtcctctccctgctgatggccttgggagataatgtgttccatgtgtgtccctgagtacggggacagctgtcgtaaatgtagtgggagctgcaatggcctatgtgtctggatgaagtgggttccatgtctttccaggttgcagactcttgagggaagcaggatcccatatcccagggctgtaatgtcagagagggcctgccagggtcagtatttgcctcttcacccagctctgggcagagcctgaagggctggctagcagactccagccatggaaggtagagctggaattagttcttctgctctaagaatggagtgtggggcctacctggctggacatggagcttagtttttgatctgcacccaaggtcccagtgcaaaacacagggcactggttttcacgtgtgtcttatctggttttcccatcagagcacacaactttgtttatgagaccgtctgtggattccaagatgggcaatgatagaaatgagcagagctaacatttattgtgcatttgctccgtgtcaagcactttacacggaatttctcttctaagctgttgatatctcaaagtgcttaacagcatggatatcagagttagcaggacttgggtttagattctgacttttctgctcagagctgtgtgaccctgggcaagtcacctgtctgagtgtctgtcgacaccaactgtccattcatccatctatccttccatttcatcagcatttatggatgcctacctatgcccagcctcgtacctggcactggaagtgaatggacaaataagacactgtttctaagaactcgagtgccagaggtggagacagtggaggtgatatcatcaggaggggcagcgtagcagagtggaaactttggcaacacacaaactggggtcagatttcagatctgtcccttcccagaaacgcaaccccagcaagtgacttgtcttcagcaagtctcagtccccattaagtggactgaggatgatgatggtgcctacctcctttggttgttggggagatgacatgggacattgcttgtaaagtgctgagccctgggcctgctgcattgagactctcagtgagtgccagctggtgtcattgatcacttctgtaaaatgggtataacaatacccagcctctccacctttataatgaagttgtatcaaataagatcatgtgtggtaagtgtgctttataaatggtggagtgcttattttatcactcattcattcagctaaccattccttgacagcctgcaaagggccaaggctacagctaggaatgagattatcaaacaggagcaagaggtaagggaaacacagatgtggctacagagtccggcatctgggaatgaagatcaattatgatcctgatgcaataagaacagccacaaaagcttctacagaggagggcaaaggaggtggtcattagctaactggtgacgtcaaggaaagcttcctggaagaaaaagagttagcattggtgctgcaaggatgaatgggcattgaagcttcaccttttaagtctgagcaagcttacactctaataagagaatcagaatgtcttcagtgacacaagaaggggtggacacaggcagattttactcattacccatccagtgtacagagaagtggtggagttctgaggacagaaatctgagaagcttggagccagctggactcaggctcggccttggaaccaggaggagcaaaagggcagaatgtgttgcctgagttctcagtggtccctcaatccacagcgacatcttccacaagtgtcaattgcagagccaagattggaacctgtatctggctgttcatgacactctgtcagactcaacagaggtgctcagttctgggctgggttatgagcctcagtttgaggtggctaacctcaccaccacatgcccctacctcaaatactctcattttctgtcttttcatgaacactctgtaaactttccctgtgaagttcttccaaatcagtccttttctgctggctatagaaaccagactgcgcactcaccccaaatagcaccccctcctcagccccataagcacgtttttacctcctcaaaccacttaccactgtcactaggacctaatgtaagtcagaggggaggccattggctgacatccactccaggaagtcacattagcaacttcattcatcagggtcaggattgagcttccattgtctgctgtaaccatttgtttatttcaactttggcggcagccccggtttattacagttatcactgtctgggatgggagagaatatacttgcctttcacacataggaatggcattcttgcattttgtagcaaaagactcacctgactcaatacctccccaaatatcaaataatgttaaaaagagaatataaatctattgatacatattctatatatgtatacatctttgaatccacaaatcaatcattttattttattttagaagaataaggaataactgtttatccagcagcaaacaaaataataaacaataatacctaatgctggtaaggtttccttgaagtggctaaacggacaaactttgctggaggcaatgtaaatgaggacatcctttatggaaagtaaattggaaaatatgtatcacaaaccacaaaaatgttcctaccctgagacccactgattctgcttctgggaatttatcctaaggaaatgagacaaagagaaacactctgtggaaaaggagaagagttcattgaagcaatatttcaaatagggggaaattgaaagtaaaattcaacaatactcaacatcaatttgatgaaataatagggaaccattaacatgataatctgtaatattggtggagcaagcaaaggcacacgtatactgtattcacctttcaagtttaagaccagcatgtacaaactacatattaacatataagtcactgtacttgcaatgggaggctggtagccttatggagaaggtttttgcccttgttttctaaacttccagttgggttctatatggttttatagtttcttttaactggagctgacaaatgatcatgcttcacgaaagaactacaaacagtgcctaattagacacagcagctttcacaagaccctcagcctgtctaggcttcatttccatgttccttaagatcctttgccccataaatgtagtgtgggaaatagacgggcctggcaagtctttttaagtctctaagtccagtgctgtgaggaagaatggatttgtcaaaacaatggctgatggtagttgagcacttcatacccatccattaaatttggtcctcatgggccgggcgtggtggctcacgcctgtaatcccagcactttgggaaccgaggcaggcagatcacctgaggtcaggagttggagatcagcctggccaacatggtgaaaccccgtctctactaaaaatacaagaattagccaggcgtggtggcgcatgcctgtaatcccagctactcgggaggctgaagcaggagaatctcttgaacctgagaggtggaggttgcggtgagccaagattgtgccattgcactctagcctgggcaacaaaagcaaaactctgtcagaaaaaaaattggtcctctacaaccctgcatagtggattgtatcatccccattttacaaatgggaaaactgaaggttgtccaggaacaacacaggtggtaaggagaggagccaggattcaaatccacaactcttcactccatagcctgttttgttgttgtgtttcccaattcatgttgattatttttctcaaatggatatagtttaaaagaagttgattcactaaaataagttcgaagttgtggcttgaagggaactcccggcagcccattcaggctgcctgggaggcccttctgtcttgaaagggaacatacagttggctggctttgcctgaaggaggaggactggcccagccagcggctgcaaaacctattgggttcaagcattccaaaagaaaacacccccttcaccaagaatgtacctcaataaccacagaaacaggccccaaagaagaaaaaggggcttgggggagcctctgactggctgctggtgatgtcatgccccagcccagaatgcctgtaagagggcctactctgggcgactttatgggggctttggtgtctgcatgctccctccctggcagccaggccagcatgacggctcctgtccgcctccctgccccctgcacatccccagcgtctctgccctggcctctcccagcctgtaattactttcagtgccctgctttatgggctccagcgagggggactttgcagcaagaggaggttccttgaaagggacccaggaatctttccagaagggcctctttctccctgctctctgagaggctttgaaagcagagccaggaggcattgtggggcctggcctcctcagacaccctcccagctcccaggtcttcttacctggcccactggctggcactcccttgccgacaatctttcagttgtccctggggactcttagaataaaataaaaatcattccctgtggcttccaagtctggggtctgcctcatcactcacaatcccccacccccacccccacagaccagctgtaatggtccacccaccattcacagacacaccacccttccttgcttctgagcttcctcaaatgccggtccccctactggaacacttgtctctcttctctctctgctcaccccattttagccgactaactcccactcacccttgaggtctccattcttttccttccattcttttccttcagggatcttctgtggacctctgtcccagctgggctcagtgcctcctcttctaggctcacagagcccccgagctttgtcctatgccatggtcatttgggtccctctggaagtaaactctacaatgaagattgaaggtaatttatgtggaaggtgaacgcaacatctgctggcagggaaatgagaaatgaggcagggacaggaaggcagccaataaagaatattatcaggcaagttcccaccatgggcaactagaggttcattctgctaggagctccagagttcagtgtagaacacacagctctgagttatctcagcctagagggaaggagccgtggtattaatccaccaggcccatcaatcattggttggagctattccagatggacgtcaattttctagcttgccccaagtgtaggcacagtgggcttgggcagggagagaaagtccctgggctgggactgagtagtcagggggaagtcaggactacaacggtgaggtccaaagggagataagtaggccctgacatctgctctactcacagccccaccagcccacactgcagttgcctcttctctgctgtctcttcaaccagaaaataagcttcaggcagacaggcatctcttcaattttgtttatgactgcattctctacataggcacattgggtgaatcaaaattatgtcctgcttggggtgggtccacaagccaaccactggttgagggattctatcacatgtcctcacttttccagctagtaaacccaaagatcccagaggcagagccttgagaagaaacttggagcaccttccattattataagtgttggccagaaacttcgagggtcaagcttgcccctggaagatccatgggcaaggacaaccgcaggcagagccagaggcctggattcaaatcccagatctgccaattactgtgtggccttgggcaagttgctcaatctgtctgtacttcagtttcctcaactatagtaactccataaggtaggcacaattaatagcattattacaaaattctaatgaaattgtgtatgtaatatgtttggtcatcattaaaatgattcttacctcctaagtatataatgagctgcctggattttaaaaaaaatgatttttacagaaaagccaggtttaatcctaaaccttaagggttccctgatacacgcacctaccctatgccaggcattgtgctagaggcattacacacgtccagcagcccatccactacgggcctgccttcaatggcacttctaacctattgtgctttgaacacctctagtgataggatactcactacatcacaagggaaccagatagattttcaaacagctctaaatgtctaatacagaaccatgctcacaggaaacatggagctctctttgcccacaacagcctcttggaaatatgagggagtggtcctgatgtcagctttctctctcccacatcaggagcgtgttccctcacagaacatgactgtgaggtcctatgtctccaaggtctcactctttccctccactggaaggtctccagtacctctgaattaaatgagagccacccgtgagggtgatctaagcagtgcagaacacaatgtatctcatcccctgctcgggacactttcttctattcatgcagtcaggggttgcatcagcattttggcagctggaacacagcatgtggccctgggcaaaccatttggtttctctgagtctcagtgtctatccataaagtaaagacaatacaggcacctaactcataaagctgttgggatgattaaatggaatgatacacgaaaagctcttaacacaatactgaaaaagtgtaggtaatattgggagccggctaaaagccatagctatgcctctttcacatgaggtcttttgaaactgggtttttcccatctttggtcttttccaacaaagtcagcaagactttgtcagactttaactgagtccatgttaaatatgttgactaagaatggaccaaagaagaccccttggcatggtccagagactccccatcaagagtgccatgagtgcactgatgaccattccgtgggaatgaatgctctgccccctatcacctccctcagcctcgctatgcctcccctgtcccctggatgtggagatccaagggctgaccacgctgttgcgttcatctctgtgtctccagattcttgccgagtgactggcccaagaacatgaattgaatttcccctattcacagatggcctagagccaggaagacagtttttgtgaggtctctatttttattctcattttacatgaaacagcattaatgatcacaaaggtagctgttataggcattcagcaggcatcagatcttcctgtactggctcaccaaatcctcactacggcatcattgctgcctccactattcaggtaaggaaactgagactcagatgaattaagtgatttgcccaagaccccatggacacaaagtgatagaagcaagatttgaacccaggcctataaagctacaagccaccttcctcctctacctggaagaatttttttattttttatttttattattattattattttttgagacagagttttggtcttgttgcccaggccgtagtgcaatggcgctatcttcactcactgcaatctccgcctcccgggttcaagcgattctcctgcctcggcatccagagtagctggaacgacaggcatgtgccaccacgccgggctaattttttgtatttttagagagacggggttttaccatgttggccagggtgatctcgaactcctgaccccaggtgatccacacaccttggcctcccaaagtcctgggattacaggcgtgagccaccacacgtggtgacctggaagattttaaagtgcttttctaatgctaaaagttgaggggaaaatgtatttggtcatgcagttcagctcacaggcctgatcccagagagctgcaacagcataaaccatctatggcagttttaaaacatagccataaatcctgtgacactactcccagtaggatgtgcacctatggtccctccccgtgaaccagagggacttatgactgctttgaccaatagagtacagaagtgacactatatgatttcctaggctatatcataacatgccatgaggcatctaccttatttaatggagccattgtactgagagtcaggagactgctattaagaaactctaatgctctactaacctgagaccacaatgctggaagctatatgtaggtgttctagctgacagttgcatgtgagccctgacttcaaccagaccaacccaggcaccagaaataagaatgaagaagccatcttgaaagtggattccccagccccagccattcaagtcatcccaggtgaggtccccagatgtcatgaagcagagatgagctgtctcttctgtgactttcctaattcctgacccactgaacttgtgagtgtactgaaaggggtgttgttttataccagcaagttgtggggtggtttgttctgcagcaaaaaagagataatcagaacaccatctgacccaacagctcatttctcaatgctctgaacttgttgatggaaatgcactttgattttcaaagtcagaagttccatatggaccattcagaaagtcatatctgacccagatactttggctgagtaagaggctaggcttgctagagacctggacttcagcgtcctgataattttggtgtcccatctgttcatttattagtagttattgcattgccaccttgtgccaggcactgtgctaggcatggagataccacgataaacaaaatggacatcggccttgcccacaggagctcacactccagtgggggagacagataccacataagaaattttaagttaaaaatggagatgcacagccttagggtcatctaaccatgtgtggccaagggagcaggactggcctaagaaggtgaccatccgagggctgaacaacagaggcagtgcccatctgatgtggaagaggcagagacaagaactgcaggcagagagaacagccggaggggaggctgtgctgagagaatgcatgaggcattcaaggacacaacagatatctggtgtggctggaatgaagacactgaggcagagtggtgagaggagatgctggacagggctgctgggtggaaatggatgggttatcccagcctaggtccccatccagccccagtcccaaactgctggccagctgaccacgtctgcttcttggagtcccctggctttcctctcatctctgactgttccttctccgtttccttggctgccttctcgttctccaatcattgccacatgtgagcattccctcctcacaaaacactcatagttctcagttgctcatgcgctcttctgataaccccaaaatattaagttgaaacacagggaatggcaatatttgaccatgtgtgacttaagaaaaaacatcacccagcaatttcaatggttcagcttaattttaagctattgcccctttcaagttatcttctgcagtgtcccaatcagcagagaaagtcttgactttattattttctgaggtttgtcattttcaaatctttccaaatatgaaattatataataatttcaaataaaattatgtaatctgaaccctttgaattccaccatgcccctctaaccacacctcccaaggcctcaaccccaactcctagatatgagacactgctccattttggtccagagggttctcaccaccctcatcttttcagactcttccacatccactggaaggttcctaagaacattaaaagtcttagagggaattgaggaaaacagcaggttggagaggttgaaactcagaatgaaataagtttggagatgatcccagcaattgctgagaatggcctatggcaggtgtccaaggtgcccagaatctaaatctgaaaggcccatgcatttatttctgccctgaacccaagaatacgatagaaaaacacaggggctaaaaaggctctcaggcttacttctccaaccagccagccagaccctgcctgatacagatagggaaactgaggagacctagagacaaaaagggatacacatcagaccttgccttgaggttgagcttagggctagaaaccaggtgtcccagtgctccatctacccctccactcctgcagagtggggcaagagtcctgagtggccagctggccatgtccaagcctgaggccagacactgctcacatgcactgctgtttgctcaagggaacaggcctgtggccatctggtcacatgtcaggcattggagtgtgaatggccagacagaggcataggtgtgggggtggatcgcaggatggagggtaattttttaaactgctctgcatcactgtccccagagatactgagaaattgggtgaaagcgcaccatctctggagcctcagccacctgggtcagggatgcggcatactatgccccctggtcaatcctgcacctttccaggcctgggaatcctgggtttttgtcccaatgtgctagagactcttgtttgtccctagcactggcccactcagaggtgaaggattgttctgggccttgcaagagctagtgtggtaaggacaggctggatctgactctttctctctctctctctttctctgtatgcgtgtgtgggtctgtgtgtctgtgtaggtgtgtgtgtgccagagagagccacagagagacaggcaccaagtgcagctccaccgtcctcattactagccagcatctactgctacctcctctgtgcccacggaaagaggaaagaaatgggaatccttccttgaccctgaggaatagctcagtccccaatgagggcaaaatctactgagcacctaccatgcactgagtgccttattgcacctcccaatttaatctgctcaacaatcctctcaggaaggggccattacttgtgtcacagctgaggaaacagagacacagcaaggctaatgggcatgcctatgggaagctccatgaggagcaggtgctaatctgcctttgctcaccatttaattcccaatggttggtacaacagatgtagatgcccagtaaatctttgttgaatgagtgagttgaataaatgaatgaagtgtcagaagcaggactggaagtggggtctgtctgctccaacggccaagatgtctcttaatttgcagacacgtaaaatgtgcactaagaggagtcaacacaaagcagtgtggaaacagaaactacagtgtcaggcattgccagggggccaagggtagcacaaaaagcagactccatttgattgaggttttgaagcttacataggagttttctgggctggccattcattctccaaatatttaataaccatctatcacatgcctggtactgttctaggagattgggatccatcagtgaggatgtaagatttttgtcctcaggggacttatatttaagaggaccagggagtgaggttgttccaggcggagcatgtagagcagggagggaaaagaggtttgtcttgggaaggaagaatatggggttcatcaagtggagcatgtatgaagtgcaagttgagaagaagctgctgatgaattggaccagggtctagagggctctgagtgcctaagagcagatgagaatgaggggagggttttagatttggctgtacatgtgtcaaggggaaaagtcaacttccaactcattgacctagtgtccttgactgcattcatggttacttttgtatacctactttttgtgtttttcttctattttaagtcatagatacagccatgaaaaatcttcagctccagaaacaagttcttagtgccatttaaaagggaaaaaaagttatttttgctcattattcacctttttcatatcttatatgattttggtattgaaaaatatttatttccacatttaaagctggaatctgccaggtgcagtggctcactcctgtaatctcagcactttgggaggccgaggcaggtggatcacctgagatcaggagtttgagaccagcccaaccaacagggggaaaccccatctctactaaaaatacaaaatttgccgggcatggtagctagcccatgcttgtaatcttagctactctggaggctgaggcaggagaatcgcttgaacctaggagctggagtttgcagtgagccaagatagcgctattatactccagcctgggcaacaagagcaaaactccgtctcaaaaaataataatactaaataaataaatgaaataaaaaataaaaaaataaagctttttttttttacgtcaggtgtccagactccagtacgggtggttaagttgcttataaaattatgtgacatgttttaatttctttaaatcaatcaatcaatcattcatgatgcctttggcaggaaaaagatagaaagcaggcttttattttattaagaagtggagttgtcaacatttcaaatgggaggttacctgacccacgtttctgcagattgttggggaaaagttaaagaagacaactttgggggtgaatttggatgtggctctgcagaagagaaggaagtggtgggtcttgtgtccagctgggactcactgggatgtgggagtgagggtggaatacagtttggggcagctcctcctgcagtgagaaaaaggtgagaagatgatagctgatctccattgggtcaggtagggctgcctgcccaggtcagggagaagattccaaggatccagtggcaagtaaggaagtgaagataaagaaaagaaagggaaattagacaaggaatcttagggtctttgtaagacaggaatggtgagtggggtgatgaagatccagacatgggcgggctggggaccagggtctgcagagacaggaacaggcaggggccaaatgataagagtacccaggatacagcttgacccatagcagatgctcagaatggtcttggccaccaggctgatggccttttttgataggtttgatagctttttggcagctttggtactttggatcctttttatgtactcaggggcacccttgctaaaggccttccattcattctttatctcattttacagatgaagaaacagaggctcagagaggttaagtggcttagccagggtcacaaagcttgtaagtaatagaatcatggcttgaacccagttccatgtgaatccaacacctgagttctttgtctctcttgggatcttgtcctgcaggagaaggaagtgcaaagaccaggctgcatatgattttcatgggcccttaggaacttttgtttttatggacccctttctttatgaaaatatgctaaaattctaatttatggctattaatataaagatgaatataatccaggatgcattatattaacattttttctgctgattttaaagaaatagaaacaattccttggacccctgaaagtattgcaggctgtaggtacagtgcctactgtgcctgctggtgaagttggccctggtcaaagatgcttcatgggtgtgatctctgtacttaagcaagcagtcagtcccctttcaaactaaccaaagccactctgtgaggatgtagccctcgggagctacccagtggatcaggggtgctcctgtggcacatgccagggacccctgcaggaggccagcctcctgaccatggcattgccttggtttttttggaggggggacagaatcttgctctgtcgcccaggctggagaacagaggagtgatcttggcttactgcaacctctgcctcccaggttcaagcgattctcctgcctccgcctcctgaatagctgggattacaggcatgcaccactatgcctggctaatttttctgcatttttgtagagatggggtttcaccacgttggccaggctggtctcgaactactaggctcacgtgatccacccgccttggcctcccagagttctgggattacgggtgtgagccaccacacccagctgccatggcacttcttgaaacatctccacctcttcaactgaacaggcagagacagaaaaggtccagcggccatgaaactcagaccaggccaaatttgtgcacacagagcaagggcaggaatatccagcctacctgaagcaccagctctgcccctcccccagcactggaggtgaacagaggctccggctgctctctgccctcctcctggaactgtcagctccagcaactgacatctgctccctgggaagagctgggtccccatggatgacctttggcatctctgtctttccccccatcactcctggcaagaagactgggcacaggggttgggagacaactgtccccagcccagcctctcagaacctgcaggcccactctcaccctgagctgtagaagtctccccatctcagcctccagaggcctcggtatctctcttctggaaatcaaaaccacccttcctagggcttcctgacaactccccataccagcccctgttgttagctttctgaaaaaataactgtcagcccttactgtacgccaggctctgtgctgaacaccacacttcttcaatgctcaggacaactccaggaagtaggtgctattatcgcctcatggggagcaatatgagatgaagagacttgctgatggtcgagcagcagtaagtgtgtaagacaggctgtgtcaggattcaaaccctgcctgtctgcctccaagcaccaggcatcctgcctcttaggcctccagtgctttcaggttaaactccctggtgcctcttggacaaagcccaaactctgtagtctggctgtcaaggtctgtcttactctggcctctaccctgtaatggccctcacacacactgctctcccacaggggagaaggcacactccaacagtccagaaccactggagcttctctaaactcccgcgtggtttcaccctcctgtgcctttgtgcattcagtttccccagcctggaacacccttcccagtggaggatctccagtggattgggcaatggggttttgagtcagccctatggggatctgaatcccaccgctgtccctgggtccaactgtgtcaccttgggcacgtcatcccctctctctgaacactgatttcctcaactgtaaaactggagccaccaggcctacttcatactgttttcaaaggaattccctgagaagggatatgaggcgcgacaggcatggagtgagaactcagtggatattccctgtgctggccccatgtggtcaccctctctccacattcgttcatctttcagctcaaacatccccacccctgagatgccttctgtgagtccctcgaccagggaggctgagcgctggcccctgggctgtgagccccagcacagggccagctgtgtggtgtgtgttggaagaagagagaagggagggagaggaaaaaattaagtgggtcagaagaaggcagctgggggttgataaatgagattggacaatggagaataatagtggaaaatgacttgggccttaattatttggtaattaggtccaaagtggctcgaaacaggaaggcaggtgactgtgttcagccagattgcccaggtaactggctgtgtaggcaggcccatcacttgtcaggatccccgtggactggactccatgccccacttacctcctacccgcaaggcatctcagactcaattagggtcccccacaccccggactggactgagtggaaagcctcagaagcagggcggggctcaactctcatcttgtgggctgctggtgatttagggggagcttttcaaaatggctttctgtcttctccattcctacccaattcctatcccccttgccctcctcacaccctccccgtctccatcctccccatccccatcaccccttcctccatcccctccctcctcctcctctgggtctccatctcttcccagagagccctggtaataatcacctccaaaccggcccaaccggtcccagaggacctgatggcctggcctggcctggcctggcctgtccctgccccagaggcaggtaaggaggtggggcggcgactcctggagtgtctgaaagcaccaattacctctgcagtccgctggcctgcccagccagcccagcaaggggccctggggttgggagggggggaggcgggcagggcaggctgttccggacaaggggactgcatttcagaccctaccacagtgcagggacacgacatcccaaaatgtccctccctcttctgtgagctgacaggtctaaacaattctgccaaatctgacacattgactcacgtttaaattacacatggaaccaatcatctggttgaaatgagtgaagtttcataaaaggagatgtaaaattcaggaaaaaaaatagcaactttttttcttgacagatacattgtttgaagctttgacatgacctgtcttagaaaacccctttcagagccagggattccagactgttttatctacctggtgcttcatgccccttagccagtgatagaggttgttggggggaaggcgggggaggggagcagagtctgggaagggaggctggttggaacagcatgaaatgtgtgtgcgtgattgtgagtgtgaatgtatagggatgcgtgtctgtaactgtatgagtaagtaaatgtaacccagatggcttcggttcaaatcccagctccacttcttctcagctgtgtgaccctgggcaagttacttaacctctctgtgtcttggtttccccacctgtaaaatgagtagatataaaatggataaaggaagagtaacctgcctcctagcatggcaataaggattgaatgatttaataaatgcgtagcacttagcagaaggcaggtggtgggcatgactgaagtgttcaacatcattactatcattagtatctgtattaatagaattagtattaataatattatcatgaccatgattactacttagaaacatgcctgaccccataagcattcattccaagttcactggtagcactaattgtattcatgcacatgtgtgcggtatgataggagaagggccccgtggatgagcaaatctttctggataaatggtagctctatattatagctttccttacaattctataggttggatgtttggcacaggtctcactgggctaaattcatggtgtcatcagtgcaaccttcaattctggaggctgtagggggaaattcatttccttgctgtttcaagcttatagagaccacctgcgttccttggttcgtgcctcccttcctccatcttcaaagccagtaccattgcattctctaacccagcttccctggccacatctccctttgaccacacctgggaaagttctccacttttgagaaccatgttgatgacatttgttccacccaaataatccaggcaatctttccaatctcaaagtcattgactttaatcacatctgcaaagtccttgtttgccacaataaggcaacatattcacaggttctggggattaggatgtggacatctttggaaaaccattattctgcccctagcctagggggataatggaaacaggccctcatggctctcaatttgttgtggtggaatcgcatcagtgagtgtctcttctggggctttgggcgctaaaagaggctgaagacagctggacccacgatggacaagcgacagctccactaagggccccagatcccatatctggccaggtttggcaacttctcccagatccaaaagggcagcaaggtgtggaccaggctctgccactgacccgctgtgtgtctgtgtggaagcagctccctgtctaagcctctaagattccttgtctgtaaaccttttgaggaccacacaataacacacgaggctcctaggacagcggggcatgcagtaggggctcggtaagtttcaatctgccctctccacaacctggaggtcaggtgcacaattaccacagcaggcaggtgtgtggcaaggaaacccatactggtatcagggactgtgactaggttctggtgggggactgtgttgtgggtaggaaagagtgtggatgtgggagcaagaaagtggaaatcagtgtgtaagagagggcgtcccggcatgcagaacccagccccgtgccccttcccgagggcccagagcctcccacccaggttcacctgaaagttaaagccagcgcacacagccccccacagttctgcgagcctgaccacggtgcacagtgcaaggcatggctttgaagtctcctgttttacacttcctaatccagaggatgcccactgctgttgtataataaagggcaatgtttcacattgcaaattctcagaacaccgagcggctgtgaaaaagcatgaggtcagactctgtacagacgagatgtcccaaacacattgttaagcaaaagaaaaaagtgggtgtcatagcatcaagtatggattggacccattttttttaaagtagccatcttgccaagttttaaaatgcaaatgttttcaaggcacaaggtagaaagtggacagatgtgaggctccagggagaagtgaggcctgtgtcaaactgcacagcgtaagctccgtgtaaaaacattcaaatcccagttttcaaagcaggcagtcagcttttgacctctatagtctttgaaaagagagtgaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggtgggcgcctgtagtcccagctacttgggaggctgaggcaggagaatggcgtgaacccgggaagcggagcttgcagtgagccgagatcccgccactgcactccagcctgggcgacagagcgagactccgtctcaaaaaaaaaaaaaaaaagaaaaaaaaaagaaaagagagtgaaaaaaatgtggtatgtgtgggtatgcaggtgctgcgtgtttgtgtgtgtatggggtgtgtgtgcatgtggggtgtgtgtgtgcatgtccagtatgtatgcatctgtggtgtatatgtgtgcatatatgtgtgtatatgtgtggtatgtatgtggcttatgtatgtggtatgtgtgtataatgtgtatgtgcaagtggcatgtgtgtggtgtgtgtgcgtgtgtatggtgtgtcatagtgtgtgtgcgtgtgtgtagtgtttgtggtacacttgcatgtgcgtggtgtgtgtaatagtgtgtgtgtgcacatggtgtgtgtgtacaaaaatgtgtgttgggggatggtgtatgtgagactgtgtgtggtgtatgtggattgtatacatggtgtctgtttctgtggtgtgtgtgtgcatgtggaggggtgcatgtgtgcatgtgtgtggtgtgtgtaatagtgtgtgtgcacatggtgtgtgtacacatatatgtgtgtgtgaagggatgatgtatgtgagagtgtgtggtttatgtggattgtatacatggtgtctgtttctgtggtgtgtgtgcatgtggggggtgtatatgtgcatgtgtgtggtatatgtgtaatagtgcgtgtgtgcatatacaagttcatgatggctttgtagtgggagaaaagagtttcaggactctgagtctttttttttctgtttacattgtacattttcttagttttttaaaacaagcttatacaagtatcccaaaagtcttaatgcaagtttaagcttaacaaactattactcctttaatcagaaaaaaacaaagacaaaaaaggaaatatatgacaaaagtctgtgtaaaaacgttacaccaggaaaatcagcaatgtttgtcttacagtttcagtaccactgggtattcctgatactgactcgagtcaaggctggtgggaaatctgtgctccctccagccccagggacatagcaggtctgcctggagagtcgctgcttgggccccagagaaagtcagcagcatctaaagccaaaacacgggatgttttctggagtcctgcacacaggcacaagcaacacacacagagctctatgcacaaatccccctttcagtgcacattatttgttctcagcaagccctggtctaggccgtggcagatccggcttccacagctgactgcccctgaccctggacatggcattgttactttctgacccttgacttgcccctctgcaaaatgaagtcagataaaagataatgcatccaaagtgcctattgcaggacctgatacatggtaggtgctcactaaatagggtttatgaagaagaggaagcccacagcccatccccgctccctgggctccagccagataggagtatgtcataggaggcctgctggccgcctggagagagcagagtccactgatcttatcaggtcagcctcactctgccccacgcagagctgacttctgtcctctagccacccagacatgtggtcccagatgaatcagtacatgtgtaacatgatctggtggccccaaggctcagagtcatcactgcttacctatgagggaagaaagataatccccttttgcagatgggaaagctaaaactaaggttatttaacttctatttttacatcttctgtcattgattcatttgatgtttaaatgagatgtgtgtgagaagtaggcactgcatgaggcttgggccaggaggagacagcagtaaaccagacctacaatgtccatgctgccacagagacaggaccagcttcaccggcatgcgacctgcatagtcacacaggactctgcagttagaaagggcaatgcctggtttaatgttctgctttggccatcttgaatgtcttaatactttttaaacaaaattttattttatttccattttgcactgggccctgcacattatgtaagtggtggtgttaggagttaagaggtcataaatccaaattaacagtgcccagcagatgaatatatctacaagggaatcagagcaaatcttggaaacatgggggtttaaccatggtggaggtggggagtagctgacccaatctaaagctttagtccttgccttcctaagggaataacattttggcagtagcctgaaaggcaagtagaaatgggtaaagaggtggaaatgaagtttcttaactataaaatggaaacagcgatctcctgaccccacaggaccagccatgacaaaattttactcaattcattccattcattcattccagcaacatacagcacccactctgctgcaagtgctgaccaggcaccccatacatccctgtcctgtgaaacgtgtgttctagcagataattatttatctattcctgggatttgtgcaggaaagaggtgtacagggtgctaacggagcacgtgatgggggctggactgggttgggggcacagttctcagccccgcccagggctgggcacagaggaggctctaggagattgcaggctggcagagcctggctctgcagagcagtcagctgtggacacaggcccaggagggagctatgggccctgctgatttgaggaggcaccatgccagcagcagcctggctgtgtcctggtcccagaggcagtgagtagaccttaggaggagctggcccagggcaggagagggtaaaagagaaataaaaagtttaattaaagagaggcagcttttggagggagggaataaagcaggctagccttactgactagctgctgtgtccctgctacttcatcgcatctgtcagatcaccttcatggccctctacagcatgtgcctctatgttacagtacaggaaactaagtctcagacaggctaagcaacctcccaagttcatgtatgatgttggaaccagtatctagtcttctgattcccagagtaaattctgctgcttctacccatgtcccctctgaacaaaaatctgcccaggtatttgacgagccgccagagaaatttctttccagcccagaaccagcaatacttacatctctcctgagcagtgggtttgcttttccttgagaaacaccatgggtctcacagttgatcttttttccctcttcccattggccactaggaggcccagcatcaactcttggcccatctcaacacagcttttatgtcatcatgtcacttctagttcaatctggactcatctaccttgcttttattttctgccttttgtttttgttttctgtttggggggtctttttaaactaatttttaatgtgctttggctcactctattatacagtttcattaagccatctccaacctcttctgcattctctacatgcctgctttgcccctccttctctgcagagagcctttctgtggctccttatgcacaaggcctgggtgaggcttcctggcttcctgttctcaccctttcccattcaagctcccaccacactctgaccagtacccagaattcaaacaccaatttccaaggaaagatgaggcttttggcccaacttgctccaaacaactgtggccatgggctgggtcacacagcagaaatatggcagcagcattccatccctgcagggtgataaccaggctccttaccctggctctcaaggtcccttaggacctgtgtgcagcctctgcttcccagttccagttatccagcacctcactccccagccacatggggcctacttgctgttctggaaactccctccattgccacctgtgagctttcacccaggctaattcctccactgagagccctgtcccccagctccatctgtctaagttgatgacaaacccaaaggctgcctcctctcctaagcctgctccatcctccccaccagctcttatcctcctcttggctcccactccatgtcctttatccaccttcctgaccctgcaccctgagtttccataaggctcaaacatccctcacaagatgccagactccaggaagacagagactctggagccatcaccacatgccttgtggtgagacagatctcagttcaaatcctagctcagccacttagcaggaggacttggcaaacctcccaggctctggaagcccccactcacagtcacatggagttatggttgggttgtacgagaatcagcaaagtcaggagtgcagaagggctgagcgtggagcaggcgccgagtgtttgatgagtgaatgagtggatttgtgccagaagctgagcgtgttcttagtaacttacatatacacttcactctcaaactcttgggcagtggcccatatacctgtccatgaccttcttggatcccagggacaccaggaagggcatggtgagcacacaccctggagagagggataggcctcaacagaccttgggctcaggcctggcccatcctcaatctcaccctcagaggaacccacacttgtccctgcttttaggggagcatgtcttagcccccttgtccccttcaagcttctcaccatctcctgtcccatggaactcccctaggatgggaaggatgttaggaggggaaggtagagagcgggctgtatttgctgatgagcaccccctctgtgccaggcactgtgtttatgctttatgtgcattttcccattcacccctcatttctcatttaccactttaccagattaccatgattctatccatgttacatatgcagaaagtgaggcttagagagattacccggcctccccaggccattcaggggttgaagccagaatttcaggccaggagtgtcaatctacagaagccagggtcttgctaatatgccaaagtgaggaccaccccacccccagtaagaacctcctgcctgggtccaaggaaggttagcctctgctctcctaagtgctggatgaagatcctttacaaggagccaagagtggacaacagtgagcagtgagcgctgagggcccaggctgctgggccagctgagctctcctggcaggggatggagccaagtgtcattaccagaaggcagagtgtgggtcaggagccggctccttgctcaccattcagagtgccttgagaaggacagctgtagctgactgcactttgtgcaaagagggcctaaagcagcagggcaggacttgaactcaaggctacatgctatcctagatgacacttgggaacttaactgggcccttctctaagatctgagcatggaccaagcgccttagagatctcctcaccagcagattgtcctctagaggagtaagtgggcaccaatcatggctggcaaggtcatgattatggcagtgaagaagaagaaaaagaagaagaaggtgggtggtggcaatgatggcgaccgtgatggcaataatagcagaggcccatgtatccaccagacactgttctaagcactttatgacataataatcctatggagtaggcacaagtattatccccattttatggaagagactgagacatggatggttaagtaatttgtccgagatcacacaaatagtgtattagaggtaacactcaagtttcagagcctgcgcttttcttcacaatgcctatgttatatttacaacacaatgaaaatggcaatcactatttattgagcatttactatgcatcagaaactgtgctaagcactttatttgcgttatctcatttaattttcacaagagctttaacacttggcagtagtatagttccattcacaggatgtaaaatttgaaaccatgagaggtgacataatacgtgtgaggtcacagggccagtaagtgcagaggtgatggtcaaacccaggcacgatgacttcagtctccccatcttaaccactgaggcacagtgcttttctgtggctgtatatgcatgtgcacacacactcttccatgagcccatgtgcacacacacacatgcataccaggatgaacttaacccacacagactcacagcaacatggacaccaaaagctggctgtgtcatcaataagttagggatccaggcctttggtctcaggactccataaagcagttcccaaggtgggaagcaagtctgtgctgcaactatgcaaatcttcgttccccagccagggctctgagcatctggacaaaaactgtgggggtgtgggggtaagaatatttgcactcaggactgaaactccagattcctttcaatgtacattcacagctgtaaatcccacttcccaggagctcctgctgggatttgcacaccaccttccaaggtcttccttccctgccaattaatttcagtgtgaattgaaccagagatcttggccagaggataaaactggttgtacctgtttgacaatctccccagctgccatgcagagtctgggctttcttcctcccaggttgcttctaggagtatttcctaagctcatgcctcttcctgtaagtcctggccatagacactttgatacactcagatccagcccccttacacctcctggggagacaccactgataagcccagccatgcccatcacaatcacagcagccaccacacacaaaacatcatggacaagttctgtctccaaaggtccctcctgaaatcagaaatgagcaagatgttccccaccttaccaagaggcaacgaaggaggctcagagagatgaagtgaccagctccagtctccacagccagaagaggagaagttgggtttaaaactacatctaccatacctacctcacctggttctgcaacctgaatttcttccagacccccattctggctccagtgagcatttaagaggaaagaaaatgtcgtcctttaggagcaatgcaggagaaggtgcatccttccctaaagagggaaggattacaagtgacagagagcttcatggggaatcaactcagacaaacgtgtggaggccattgaattccaggcagcttctggagactggtttggccagagcacaggatgaagagtaaagaatggaggggcaagggctgaagctgcagagccctgaaggccaagctaaaggattggaaatgtgtcctggttaccatagggagcaatcagtggtttctgaggaggaccaggtgccagtatttccaaagaaaattaatatttttttggagacagagtctcactctgtcacccaggctggagtatagtggcgcgatcttggctagctataacctttgcctcctgcattcaagtgattctcctgcctctcagcctcctaagtacctgggattacatgcatgagccaccacactgggctaatttttgtatttttagtaaagacaggattttgtcatgttgaccaggctggtctcaaactcctggcctcaggtgatccacctgcctcagcctcccaaagtgctgggattacaggtatgagccaccatgccaggccaagaaaattaatttaaaggcaatatccctaacaaagcacagatggcttaagaagtggaagcacagctggctaagggggacactcctctcaaagttaaatctccactgaataaaatcccagaagcattttccagcctgttacaaattcaccaacttcagctatcatccaaaccctggcctcagaaaaggagaaagattaacaacatagcctccagattcagacttcccgggtttgaattctagcactggcatttactagctgtgcatccttgggcaagttgcttaacctttctgtgattccatttcctcattcagaaaacagggataattatatccccctaactcactgggttattacgaaggttatgtgagttagtggtaaaacgtttaatagtgccaggcatatggcaagtgtctgtcaaataaggatctttgtgttcacagaccctgatctacctatcaaaatgaaaatagaatgagtatgacatggtgtgttcttaatgatccatttctaggtccttgtgatcaccaattcctctgctacccaaaaacaatcccttggataatatgcctcaaaacatttgggctcacaggtctatcatatgcagaataaacctattacatatcaacaatttcatagggttcagcctaatgcttccacttttttgagagctggagtttttgacccattttagcattctctcttttttatactctctttccccatgtcaacagagaaaggaaggtgagttcccaaaagaacacaagagagccatccttttcagagaccttgagaaaaagaaagatctttgagacatatggtatctacaatctaaatgatatgtaactttcctattatacaaaaaatataaaacccaaggtcactctctgttgaccttgaagaagacagaggctggacaagctaacagccagacaagtatggatccccttcagaagattatgtgagggccagggcaaactcttgcactcagcttctgcccttcaatcttccccaaatcacctgagagtctgacgtcagcatcttggactgccaaagctatagttctgtttttgtttcattgacacaggaagaggctctctaaaagcagaacccagatgaagggtggctgtcaggcttccaggaggacatttttcctgggcaatcagggctgggaaaccaaacatatccgggagcagccacgtcccccttatccccttgtattcctctaaagacctttggctctttacctcgcactggaagggatcagatataaatgtcactaggtccatttcacagctaggtaaatagagtcggggaatctgactctcagacaataaacagaactgaattttgaagcattgctcttttctggggcaaagaccaatgacttgttgattttgcaaacaaggcagtgacatgatccatgtttgaaagaggaccctggtagtcttagaggaatagggtggggactggaggtgagttctaagactctgggaattgaccaagaaggaagtggggggatactccaaactaagatgtggtggtggaaacagacaggaaggtgcttctgagaggggatacaaaaacagatttgtccccaagaaatcagcttgtttctcaaaaactgaaacaaggattcaaggaggttatttgggctggtggtattagcaggcacctggagacacaatctctcccggctctgcttggagacagattcccctgactgtatttacctagctgtgaaatggacctagtgacatttatacctgatcccttccagtgtgaggtaaagagccaaagatctttagaggaatacaaggggagtagggggacatggctgctcccagatacgtttgggctcccagccctgattacccagagaaatatcatccgagaagcctgagagccacccttcatctgggttctgcttttagagagcctcttcctgtgtcaatgaaacagaaagtaggagtttgggaaggctgattttgacttaaggacactgaatacaatcttttctgggtgtttacaaagtgtgtttaccaagcagccactctccaaaccctagcaactgcttaaaacaagagagctgctgatttgtggagtgttttcttttcaaaaaatatcgccgtaaatgttggatttagagacattctttccttttaaaaataacttgtcaaggggacaaaagtatttaagaggctttcttctcagctcagaaagccatagggaggaggaatggtttgttttggagttttttgggtttttttggggggggggattttttattttgcatgaggttagagctaggagtaggagaagtaggaggggcagttggaaagcaggtgggatgttggttagctctttgccttcggaatcccaaaccccttctctgattgctccttccctcacctttttctctcaaaaacccaccaggatctaggagaaaacaagattgagctctactttgccccctccctttccctttccccctcccctgcagtcccaccccagcgctccccacctacctctcatatcaggtgtcaacttcttctttctctccacagacgccacagtgtgtccccaagtgcaccactgatggtatacaagattttggaggttgacatacaaataagctttaaaaaaatttttagcagtacgtattttttagagtaccaaaaaacacagagatagatagacagactataacagatagatagatagatagatatgattgacagatagataatagatatgaatgacagatataggtagataatgatcgacagatgattgatagatatgattgacagagagatgattaatagatgatagatatgaatgacagatagataataggtagataatgattgacagatagatgattgatagatatgattgacagatagattaatgattgactgatagggcgagccaggacctcaaacccatgctttcacagatattacccctttcctttttaagcacattttacacaacacatgatcattcaaccaattattgggttgttatggtcctactaagtgccaggcaccatttatcgttcttaggaacatcagtaaacaaaacagtcaccagacactgatctcacagagcttatatgctggcaggcaaaagcaggaaataagcaagaagtgaataataatctgataaattctaaagtgattagtgctataagaaaagaaataaagaaaaaaacaagaaaagaaatattaaagaaaaataaggcatgtcagcagtgcccagggagggggaagggggtaggttcccaaatttaatggggtagtcaaaataagcctcatgaaggaggtgagatttcagcaagaacttgaaggaggtgagtaagttcactacaggtttatctgggggaagagtggttcaggcagagggaagagcttcagcaaattccctaagcaagggccataaccagcctcttccagaaacagtaaggtggccagtgtggctggaacagagtgagcaaggcaagaaagtagagggagagaaaatcagaggagacagattctgattctgatcacttattttaaatgtaattaaaactaaatgaaatttaaaattcagattctcagctgcatgagccatgtttcaagggtttaatagccacttgtggctagtggctaccttattgggtagcacagataagaaaatttctctcatcacagaaagttctatcagatgacactgaccttgagtgttttggctccttttttggcttggttaacttttattcagactttaacagctcaaacatcacttcctccaggaaggcttttctgaccactcttcctgtacatcagctccactgtcctatgcatgctctcagagagccaggtggctttccttcgtatcagttatctctttgtgaaatcgtacactaattggcagtgcttgatggcttgtacctgaagtcccagctactcaggagactgaagtgggaggatcacttgagttcaggagcttgaggctacagtgaactatggtcactgcactccagcctggatgacagagtgagactccattgaaggaggaggaggaggagaagaagaaggaagaaattgtatgctcattagtacaatatcttactgatgtctctctctcctaatacattttaaactccgttgtttctgttttggttcattgttatattgccagcacctagcacagggcctgacgtatgaaggacaaataatttgttcaacgatccaatgaatggttttaggtggtaggactagaagcagggtattcactaaaaaaaaggttatagcactgtggagaactgtgattcagtaggctcctgggacccaaaattttgctgggtgagagcagctccagaggctggagtccctactgcaccaaacttggattcagctcaggacccttaatcatttttgcacccccttctcaccaaggcccccacatgctgtccctccaggataacaacagcatagcatctgtctttaccagagaagccaagtctcagatattcacataatgtctcttcattccttcagtcctgtgcttgcagcagcagcagcggcagcattgaaatgcttccttctgctgctcgcgaatccgaggagtggggaccgaccttggcacatttgctgggatgcctggctaggcaaggagagtgccgtgtgctccagcacgtatgtggccgccctcatggagcaaatgctggactgcacagccctggatctgacaggtaacacgcagcagctgcatgatttaaaaggccttgtgggaagaggttttgtctcccactttgagagcttgagtgcttcatataaatatttatgggagtctggggcctccattaaccctaccagtaccacatttcacttgttacatggtgcttgtctgtgaatgaatgtgaacacccgtgttcagttatacatgcatgtatgcatgtgcgtgtgaggatgtacatggactcctatgcattttgggagagcatgtgtaatcaattgtatctcaatgtgagtataaatacatacacttatgtgcacataattgtgaacattgtatccacactgtaaatgcatgtgcatgaatatttagacatgcatgcatataggcatggatacatacatatgcatacatgtataatgtatgtgtatatgtttgtgtgcatgtatgtgggcacatgaatatgagagtttgtatctagcaaatgagcacatgtggattctgtgctccaatgtgtatgcaggcctgcctccatatgtgtaagcctgagtgtatacacatgcatgtttattcatgcacctgctctgagaacatatgcatatctatgtgcaggtctagagcttcaacattaccccagaaatagctttcattaaactatgggcgattccataaaaattgcctcgcctagaggctgctgcttctataaacacttgttctggtaattatgatatatttactggtaagttcaattgagaacagatgaaaggtgaaagaactaactgttcattaattgcaaacagtaccaatgtcccaagacaatgatgcccaaagtgtcctcctccaccacacacagacacacagacacagacacacacacacacatacacacacttcccaccaccatactcctctgccagagattgaaatgagcaacaaagctgcagtttctctctgacacccttgtcatcatgtttgtacttgtgcatctccaaattcccatcacccatctctttgcctggggatgcaaagagagcatcttatggctggagaacatgaagcacacccttgtaaatgtaactaccctctgcagagggatttagagaggaaactgtcatcaaagatgactatgtcccactcctccatacttccccccacccgagtgtttcagataaggcatagtggacttacgaagtttggtgacaaaaatacaaatttcagcaccagataggtggggactcaagttctagttcctccacagggtgacactgagcaaatagtaaccactctgggctttactcatctctgacctgcagataatagtaacccatgcttcatagagttaagtgaaatgtaataatgaaactaatctcacagtttggttacacttctgctttgtgaccttcctgcccattgtccacagaaagggacatttgtgccatgctctggctcccagaacacaaaggaggatgggtgtcaagccctgcaatgggaagcacatcccttctctgtccactcaggacaggcagaagtgagcccccaggccagtccaggtccatgatctctctagagtaaagctcaggtacctgtaacaccagcagaagcagggaagtgaaggtgccagatccagagaagaaacaaagggacaccaagagtgagctaagggcagctgtggctcctgaatccgatggagtcctgggctatgatcaatgtctgcctcatgctccaaagctctgaaatgggcaccttgtagtctcccaccctgctgtccatttactgcaaggagtccaagcctaggtaagatatacagatctccaaaaaagaaaacacaacaatataaatgttggacttgtggatttcatctcccttcttatgctgaaactggcttcttccagaaagtaccagggctcctcccattgcctccaaagctgtccctccagcccaaagacaacatccctttttgatacaaatacgaaagaatgtgtaatgagtggctggtatatttcatgaaagtaacttcacatgaaagaatgcagagaggcagctaaaactgagtttggcttcataacaaatcattaatataggtgattttccacattgaagtagtaacttatttcatgtattctatttcttccaagtgagaacactgagctctgattttcttatctaaatgcatcttttaggaggcattctgggataatgtatataatgcatcttttattatcctaaaagataggataatataagatgcatcttttagtatgcatcttttaggataatatgtgtaagacaacggagaaagacattaagaagactaagtgtgaggcacaggaaattgacagaacgtggtaacggtgttcagaaatgaaggaggcatacggaggatgcggaggagatacggaatatgtgctccccagttggaagaggtgctctccatggtctggacacatgctccaagaggcaggaactatagaaagaataaaatttcagcagtagtagctgccgccttcgccaaaataaggctaggcttctaggccgggaacgcccagcctgggaagccgagtaagggctacttccacggaccaggtactccctggacgcagaactgtcccttcactgcagctggattgtcttctgagtgtactgggctaggcaacagcacagagcagctttaccaaccagattgatttcttttaggagggctgctggaaaccatgctgcctaatggatgtgccatttgaggacttttattttgttgggggggaggaagagcagagcaaacctctaatcttctcttccttacataacaaatccaaacacaactatctctgggatgggaggccaggccagcagactgcaggctgcagagggaagggttacgcaagaagccagttcagagttttcctttctgaaaacagaagggcctggagtgcagattttgcacctgaaagcctgcaagggaatgaccagaaactctaaacccactgtctccagaagccaggacaggaagagcttggggagtggggatgagagagcaagagagtagggggtttgcctggtgtggcagaagctgcaactccaggtcacagagaaagccaagtgaccagcctggtggatctggcgtggttcctggcagctcccactgcagtatgggtccaagaggcctctgggcgggcacaggctgaagcagtgggtaggagtcgagtgccctctgacaggcaggggcgttgtcctgccacagaaatgcccagagacccgggactgagggaagcctgcctggttcactgaaagagggatctgggtccagggcccaggctcagcttccccggagatcccttcccggagaaccgactggtgccggttcccccgcagcggggcgccgatccccagcgaacctcgccactgggggaacctggaagggaaaagcgggatagttggagcggtcaagacgagagcccggagcagcgggccctggtcctagtgctgcgcggtggctcgggggactccagagtctcattcccccgcgccgcacactccagccacctcgggaccccgctcggcagcccttccccgccaggcagcgccgagataaaaaacagaagagaaatcaaaacagaaggagaaagttttctgaaatgaaagaggttacgaaggaagggctaaaagaatgggaaatgtcaaagaaagaaaaaggatgccaggaggcaagggaatggtgcctaggctcccacccgtccccgcgcacaaggacccgaggctcccggcaagcccagctgagcgccttccccgacccgcctctctgaaagtggcggcggcggatccagtccgcacagcctcccgcacaccccccagagatccggggtcgcaagaggcgggattcgcgccggactagactgcagctgctccagccacgggcgcggtccgaagggaagccctcgtccgggggcctgctgtgccccgtgcgtgcgtccgggtgtctgagcgtgcctgtctctgagtgcgtctccgggtgcaggcgccagcctgtctacgtgggacgggtgctgacttggaagactcccggccctggaggattttcccccggggatgtgaaggattgcaaggagcccgcgagccgcagggagcggtgggaacggaaaaggaggatgacggtggcggggtgctgctagggtgggacgtgcccgagggccttgggactcggttctcttttcctgggcttgtgggctctggggcatcacggcgggtcgggacgacaggctacaggcggagacgcagccggggcttgcctgatgtgcgagtccgccctggaggctccggaagcccgggcctcctccaaggagctgccggttccgcctgactctcgcctgcttgcgccccgggccggttagtgctcacttggagggttgatgcggggactgacagtgcctcaatgtcagtccccgcaccatcaatgtgggtatcaatgagggcatcaatgtgtgcaggatgtgtctgtgtatctgtgtgtcagtgtatcactaagactgtgttctgggattgtcagattctccgagaggcagctggtcactccaaaccggcttgaaccactttgtcttctggatgcaatgttgatggtattggtcactgggtcgatgtctgtgcttctgtgctctggggaagaaaagccaacactttggagtttgcaaccctccccagctcagaggctaaggatggagaatgtcagtccgcttgggacgattccaaagggagtcaggccgccggatttagggtctccaccagccaggagttcgtgatctttttggtctctggagccatgcagtgggatttcctctggcaccctacctgagcgaagcctctttcaccacaaagaggatacatgtgtacatgtgaaaacattctgtgcaggagcatgtgtgtatgcagttacccaactaatcaaagccccttgctccttcattcatgcacatggggacaaaggttccacagagccaggctcagctgccctctcctcccagatcacagccaaagccttccccaccggacacatctttcatctttctgccagtgaaatcaactgggcctaggaattaaattcgagctagaattccaagcttctctcctattgaacaacaccaacacactatataaatgtacatgaatgttaatgttatctgtatcccaaatttttaggtccccttcctcttctctagacctcagccatcactacctccaggcttccagggatccaggccaaaattccctgttagtttcactctccttttccttctcccagctcagattcccagctggggctccacttcatgggtctcctacacctccccatttgggttctgaaactccatgagccagagaaccccaggaactaaacgctaagcctcctggactgcagataatgagtctaaggagaccggagcccctcggagctagccattgccaaaggatcacaaaaactctacaggggttggagatcctactccatgtcccaggggtgtctgaggccaaccctgagttatagacaggactccaaggaggctgagaggggttgggggtgacctaggtgggcaccactcttccaagaatacggaaaaggaaaggttctagggccacctcccagtcagggatctccaggctgcagccaaagctgctgcactggagtgatgacccaaacccctccaacacccaattcaaggagccactaaaattcagactcggccacacagtgcccatctgcagaactgaggaatccatgcctcagcgccagtgcacccgaggcatactaccgtcaaaaacacaagtccacacagagaggtgtcctgcctggagggttttgcaccccaagatccagtgctgggttgtacctgcttctatcagctttggggtgagggagacaggccccattcagagaaggtatctggctctgggcagctccagttgctcccagagagatgtgctgggtaggagaaaggagacttgcaccccaggcaggaaggcaaaggcccgggtcagctgggccagagcgccaaaaagacccagcttccccatcaaggtggcagctcttggcttcctagtctccatcaatcactatttcagagcagacagactagcaagtcagttctggtggccaagcctgaaagcactgaaaaagtggcgtgtgccccacacccagggactccaaggctgtttggacctgcgccctctcagctcataatccagctctcttgaccagggtctgtacctagggtgggaagcagagaacacatttgaggctcatgtacacacacactcagacactcaaggaagggatttgctagggcttggtttgctattccattggccatggggtgagagtaacccaaagttgatgcgactcttgaggaagcaagagaagaaagtcaaaatcatgcgaacgcagagtcctctaaataaacaccatttccatggttttaataagcaaaataggaaaccattttaataaccaaaaaacagaaaccagtctgaataaaactacaatagactaggttttaatattttcatatcataagcagggtttgaaattgatcccttattttacatgaaataaaaacaatttctgttgcggcaggtttgatttcaacacagttgaatctgtaaaaaccaaagctcgtttctgatgcaggacaaatatccacaatatttaaaactgcaagcaccatgcggttcatacaatcttgttattactgttaatttatcaactaatacaaactcaaaaatgcatccggccagcagcgccagcaatttcaaatgggaacttaaaaatacacttttattttggtatttttgtcagtgcaacttaaatccttttactgacctgcagaaaaaaaaaagtaataataaagaaaaacacccatatcttccctataactactatacaactgaagaattgaaggggggggacaccaccaagaactcttcctactatctcaaaagcagggaaagaaacgcaatgcattggtctaaagaacgcacttgaaagttgcaaaattacttgccaatgtttgggtttctggtacattctgagcatagcagttggttcagtgcagtgtctgcttaccagtgcactgccagggtcagggatggctaagcctctcaccctaggagcgctgtggctcctacaattagcgcaggcccagagggttcagaagggacctcagggtgattctggttacaataaaaagcagaggggaggatctgttttcctttcctttcctttcttattaagggtatcaatttgaccataagacaaggctgtagtccagaacactcctctggggtgcggagcttggcagcttccctgccctgccctgcccttgtactgggacctctcggttctctctctcagcaccaacaaggttgaaaactaaagcgagagaggaaaaagaggaccgaatggggataagggaaggaaagaaaacatgcaacttccaagtgtgccccaagacaaagttgttttctgatgcaaaatgcccggaactttttctttttttttttctttttaacttacaaacaaaaataccgtaataataaacccaaacaaagaccctcagcttgctgccacgttctctatgcggtttggcggggcgggtatttacaagcctacagctgggactgaaaccccgcacgcagccgccggagtttccaaactgcgatcccttctcacccaaagaaacaaggggagtatgatccatgatcaacaacatgctaaagttaaacaagaaaatggtacaaaatagaaattattaccatacatgtccagcatgcaggattaatatttttaatgcagattttttgtatttttctatataatcgagcaggcaataaaactgatgagatttgggcgccgagcgtcctaactgaggcctgtgtctcagggctgagagccagtgttctccgaactctgacagacaggtccgtctgtccttccttctttcgctcagcctcgcctctcgcctgccgggacgccagagtccctctcctttcctcgttgctctcttcctggcgcggactactctccgggcagcaaagcagctgtcccggcttaacgcgcaaagttcagaaagccaggagtctccagatggccttggtgacttctcgggactatgcctcgccgcccttcagcctggagagaagttactccgggacctcccaccctctcgtctctctctccggctctgctcgagtctaggaggcggcgctggcgtgcgctactctcgccttagccaaggtcccctgcccgcccgcgcacccgcccgtcgcccgcggcccgcgcgcccttcctccctctcgctcaagtcaaacaggtcaaggctggggccgcggcagggacagggtccggggtagtctgggactagggacgtgggacagggagtccgggccggggcaagggcgggggccaggaccggccacgactcacagaaagaactcgggagaggaggggctgtcgctggtggagcccgcctccctgaagccggagttggcgagtttctcgcacttgaccttgtaggcgtctctctcgcgggccagccgggacacctcctgcttaagctgctccacctgctgaatgagctgcgtcttctcattctccaggtggtgcttctgctggacgcgtttatacctgcaagactgggcgtagccccggttcttcagggtccgccgcttctgcttcaggcggatcacctcgtccttggtgaagccccgcaggtggcggttcagctcgcgcacggacatggacacgagctggtcgtcggagaagcggtcctccacgctgccgttgccgcccgccgccgtcgccgaggccgtcgcgtgcggcccgggcccggggtggctagtgggcagctgttgcgccgggctagcggcgctggacggcggcggcgacgcttggtgatgatggtgatggtgcgggtgagcgtgcgggcccagctcgtcgtgggccacgccggcgcccgggtacgcgtggtgcgggtgagggtggtggtgatggtggtggtggtgagcgccgcgaaagctgtcgaagctttgcagcggctgtggcactgggtgcgagccgatgagcgcttccaccgcgtcctcgggcgtcaggttgagcgcctcggggttcatctgctggtagttgctcgccatccagtacagatcctcgaggtgtgtcttctgttcggtcgggctgaagctgggcgacgagggcacggagctacacggagtgctgagcggtgtggaggacaccgagccggctggctgcaggcgtgtgcagggcctgcccggacgctccgcgcgccccagtggctccttcttcacgtcgaacttgagcaggtcgaagtcgttgacatactccatggccagcgggctggtgggcagctctggccccatgctcagctccgcggccatcgctgaagcgaggcgcagccgccgctgccgcccgggaaactttgcggccggccggagcgcgccgagccaagcgcgggggggaagagcggagaagagctggggaggcggggagcgagggcgcagcgggccggggccgccggccaagcctttgtctggggacgcggcggcgcgccggagagtcccgaggctgcctgcaccgccccagagctctgggctgtgcccgcgcagggaccgggccgggtagagtcgggcggggtggagaggcaagcggagcgcgcggtggggctgaggggaggcgtggggcgagtgcccgttgctcgctctctagctctcttgctcttacgctctctcgctcgcagccgctcgcagctcggcggtgcagctgtgctggatccggcggcgccgcagccttttatcgcctcctgatgtcactggggtgcgggggcccgggcggcccggtgcgcgggccaatagctgcacggcctccgcggcccagcggcgcagggcggggcgcgcctgacagctcccccgccccccgcgtcagctgactggcggcccgagcggccccggagcggcggaggcctggcggagcgctggagcggagtgggacggccagcctgggcccacccccgtaccctgcaggtcccggcccacgcacgctcgcctggagtgcgcgccccacctctaggccaaatcaccgctttcccctcctcgcgcactctcctccctcagttccctttgcaccccacccccatcccgtgtcacccccaaggaggctcagaatgagcgccgggacaacgcctcctgggccctttgttcccaagcggcccccgcccagtgggcgacgctctgtgtgtcctcgcggcttctggccgtgtgtgtcgtgcgttcctgtttctggagatctgcgcgtatttgtatgttggggagggcgggctcgaggctccgagagttgtgttcagacccaactcttaacctcaggggacctttctcaggccaagcgagggcccctcctggcgggtgcagtcgcagagccctgaggttcgactccactggccccgccgctccccgcgttcaccccaccgcacaatgttcacagtgaaggcgacgggaaaagcagcagcccaaaggctctgaattcctcttccccgccacacgcacggaatcctgagcccccggagcctcggggccgaggccggcccgggacggtgctccgagtagctctccactgctggggagccggccctgtttttgtttgaacgttttgtaacgattaagcagatcccggcgtcagcccgccgcggagaggctcaaacaggcataaagtgcgaccccaagtggccactgtgcgcaaaggcgccgcgaccgcccggcccacggccggaaggcttggacggcgcctcgtacccagccaggtctcccctacctggcccaacccaagccagcccagaacgcatactatgtgtgcaccagagcccaggacaggttcccctcgagcgatgtacaggtcctcgggtcccgtcttcgtactcagccgcgagcctcgagccgcgagctccgctctggtcgccccgttgaaattccgtgccccagcgttcgggggtgcccgtcggctgctccctgggccggaaggtcctgggcggaggaaggccggtagccaaaagtggaagcgccacagtgaagcggcccagggccaccgggtgagaaacctccccggagggcagacggggagaccgaagcacaccgcactaggcatccagactgggcttgggagccgcgcaccctccctacccagatccaggatggctagaattaacgggttctttctgagacctcggctcaggcgccgaaaccggatagatcgcgaattcgctggacccggagacccgacccgcctcccgcgtcaccttcttctttctagctttgggcgcgcgcagcgaaaggcaggagaggcgcgcactgggtgagtgagtcccggccgctgtctgcgctggaccagcccgactgacctcgcgcgtaggggtcgcgtgagccacaccggtgcagacgcgcctagattatttttaaatgttagaaggtaaaatatttgcctccaattaatctgaaaactctctattctcttgcgccctcggagaggctggggtacggcgtggtattgggccgcctatttttaataaaatgagtgtattttaactaaaacttaactcaatcttgtggggtggcaaattaaatgctggaagagcgcgtctacaaccctcttcgagaagcgtgctctccgcagaaatgagtcggccgcctggagagagagcctgggcggtgccgctgcgcagcccctgccagtagctgggggttggggactcgcaccttgtaaatgtcctcgtcttgtttgaacgcagtgagagcacactcgtttccagatcactcgggaccgggtgtctcggatctgtgcagactatgtatggctccggcctcaggcggccagggcgggacaagcacgcctgactctcttggtcccgactggactagagctggtagcaccctccctcagggtcctaagagacctgtggctcccagagtgtttctgccactgtggacttctgcgcgggcaccaagatggacaggccaagctgtgacccactccacccccgcccatacgtcccctcggctctgcctgacactggccgtcgaagacttccgtggcccattaaggccctggggattcctgaggccccaggtctgcggttccgaacctcctcttctcctgcgggcggcctgcctccgactcagggtctcttggactcgggctttgggcaaccgcgctcttctttgtccctgtgcctctgtctctgttgtggtcactcccttcgcctgggctttgactgtggtatctctgtccatccccaggctcacttccccacccaaatccgtttctctgcccctctcccagcttagccactccctcctctgcacaccccacaacctaccccaccaaaaaaaaatgttggaaacagccctacccctgccaggctgtgggtgaatgacggagacatgcaggtggccgaggagttaaggccgctgctgcgcagccggccccacttcgtggcctggcctcccccaccccggttactgctgcgctgacttggagccccaggccctatagcctccaacttccgactgctgtcgcgggatgccgcttctcatctctggggtctctggatcagcatgccaggctcggctccccgtcatggatacacagcagtgcccgcagtcttcaccctatccctaaaacgtaggcagggttgaggtgaggagggtgagggattgctgctgtatacctattgactgggagtccgacacgctcaaagaaaaaaagtaaaagaaggaacggtggaagaagtgaagggtcgaggagaagtaaagggaggccaggagacacgcgagcagtgcacggagtcccaaggcacactgaaggaaatgcacggagtcccaaggcacactgaaggaaagtcggggattttgcggcagccacagcccctctagtgaacagcttgttgccaaaactcccatttaaggtgtttacccaagagtgacctcctctctacccacgccaggttgggccagaggctatgcctctgggacgcaccgcctcgggattctttagctacaaatggtgatggaggaagctctgcagggtccgagccgctgcagagccttggagcattcggggtaggagtaagagaagaggttattccctaagggagcgtggagcccacagccagccgccaggtgtgaggtttgccgcgctgccctcgttggcccccactcagccgagggaataactccagagaggcccggcggcgtgtcctcccgtacgcctggaaaccagagcggcattcctggcatcctcattcagcccgaaggtgcgccgttcaccttcggcgttatttccctgagggttgcaggtggttggtgagcgaggaggcgtctctgtgcacgcatgggtgctgttggaggcgtgcgggaggggtgtgttcgtgcgtgtgctgtttgcgcgcgcgtgtgtgttggtggagaggcgcagcagcacgcgggatgcgggagcgggaaacttccagcttcaaagctcggtgggctccggatcgtactatgcggagtcgctaagcagaggccagtggtctcaagggcctcagaggcaagttctgccagggagggtcctgaatcaggggacccccacctcccgcctgccgcaggagcttgacttctgcctttgcatcacccagatgtagtgtcacctgtcttttccaaggagccctcaggtctctgccaccttttgtgaggctcagtggaaaagtattatgttgctcccattccgtgggatcctcccaaggtctatggaacccaaaaagagacaggagggttttctgggggatttttgtttctgttttttgcccttactcttccttttcctcttcccaaaggcagctatcacttccactttcccttgccccatacaaccgctgtcagattccaacccagtgcttctaaaaaggtattcttgggtttctgggtcctggtggtctttaggcaaccaaaagattcagagggtcccagtagggagccagagttacactgactgtgaagatcctggctgtctctcctggggaccagggacaacaccccaatacatgcagaaatgtgcacgcgagcacacacacacacttaggggtaggaaattattattaaaactatttcactgtttttttttactgtgttctaatgtgaccaataaataattttaaattacacatgtgcctcacattctatttctgatggacaagcctgcattagataaccactgggcagtattgcttccaacacagatgggatatttgataatagtcactctcatttgtacagggagttgcaaagccttttgtcattcacctttttgttttgttgtttttgttgttgttgttggtttgttttattttattttttgagatggagtctcactctgttgcccaggctggagcctggagtgcagtggcgtaatctcggctcactgcaacctccacctcctgggttcaatcgattctcctgcctcagcctcccaagtagctgagattaaaggcacacaccaccacattcagctaatttttgtatttttagtagagacggggtttcaccatgttggccaggctggtctccaactcctgacctcagatggtccgcccacctcagcctccatcattcaccttttcactcaactcttacaactctgtgaagtagtaactattattatccctattttacagagataggtaagcagggagataagtgggtggatgcagatatatcacagtgtcttaagagcattttgcatttaaactcattcagtcctcacaactgccctatgagatgagtaggattatctccatctcacacaaagaatgaggctcgagaggctaaatgatttctttacagttatacagcagtgatgagctggaacttctggtcccaagtccagtgctctgaatactatgaagcgtgtggtctctgtgtcaactgaatagcatcctggggattctggtgtcagtacggtgcttctccacctgttctctgggtcaggattttcagctgccacaggattagtgactgttcagttcacagctgaacctttaccaagtgtcaagtccctgccaataatttgattatgaggacagtgtttaatgtgccttcttatcagtggcagtcaaacttctcttttcccttttctcttccctgactgtgtggggctggagagaaaccaaggcaggggtaccggccaaaggagaacaattttgcagagtcctctcatcctgtcctttacccttggcatcagcctggcctctgatcctgggtcctgcctctggtctgagtttgaccttcagtccatattcatacatccctaaatatcaaaggaaagagacagagaaaaagagaggggagagatgattcagtgctgatgagaagctcactgctactcaaagccactgtgcagtgaatgataaccaggacagttcccttcccactacacctcccccacccatgaccccagagccagtgtcaggaattctgaaacctcattattgctccccagggctgaggccctcacctcccatagtctaactatcgcctctctatccttccaccagagagatccaccagatctctctggttcttcatctggtaccttaaccttcatccggtaccttaaccttcatccaagccacccttatcttttccttagaggattgcagaggctttggctgtagactttctgcttctccacagggcagtagagatagtttttatatgaatctgataattccccctctcccaccccctggcttaaatacaaatcactttaacacttggaaaaagaaccaaattccttggcatagccttcaggccatggatggtctacccttgttaccctctcccacctcatcttgctgcatcccccatcacaatgctccaggcacactgatttatttaagttcttccacagcccaagctgtgttctgccacaggacctttgcatatgccattcccctgcttacaatgagtcaatctcttgtttctgaggaacttagaagacatgttttatggatcttcccaggccttggagggacttgggtgtacctaggcatgggagtggggtgaaaagcctattagcaaggacaaggtcctggtcattctagggaaatcctacacactggagtcatagggcaaagcttgtacctccatcccatctttcttcaacctggatcagggtagacctcaggtttgggagaagccttaggaaataacacagggacattcaaggaaatgatatagtcagctagtccaaatgttttacacttgagaaaatgggttacaaacacaaattcgtgagccacagtctgattttataggtctgagtagagcccaagaatttgcattttaataagttctctgggtaattctgatgcctggagttcaagaaacacactctgagaaactagatggaatttgatcatgagctccagaggaagtctccaggaggtggagttgtctctgtgtcctcagtagtcagtgcaatgcccataccaggaggaactcaattacaagtgtggaataaatgaatgaataaatgaaattaataactaggcaaaggctgatcttccttacagtgtgaggtctgtgaattgtcaggccttttctgcacaccctccagccccctcctctccctgagttagcagtcattcctgaaccaatccttccttcttcctcctgatgccaaggactaactcaagaaatctgcatgatttgagttatcccaccccatgggcctccctgctttcgctttcttcctcctttgtctggatgctcttcaagggcccagaattccagcttctcactacatgctcatcaccacatggagagcaaacttctcaggtacaggggaagtagatggcaccctcccactgccctgggacctgctgcgtgggagtggtggaggaaataatgctgattggctgtgtcaaagcccagtctccattcagccaggagctgctgtggtcattcaatctctttttaaaacaaattacagaagatcacattctcattgtgaaaaaatgcagcaatgtaattttaacatctatgtctagagctacagcttgcttttgatttttactcagcaaatgcttggtcaatacatggaaatctacttctttttaactaatgcatagcattctatccaatggatgccctatagttttttatccaggccatattgaccgacatttaagcaatttcaaatcttttactattgcaaacaatgctgcaactcagctttttacatgcgcctttctgcacatgggcaaacattcctctagaaagcaagaaataaaattgctgggttgaaagatgtgtgcattttcagtgttaataatgtcaaattagcctctaacaagatggtgcctatttcatttactatcagaaatggaaaatctgtttccccatagccacaccaacaatgaatttcatcaaggttttccatttttgtttcagttttacaaccagtgctgggagatgagggttcagggatgaatatggcttccttcctctcctccaagacagtgcaaaccttgccattgtgacatgaaaggtgttgtgatggcaatatgtccacagtgcttctggatcccaagtaaaagatccctggttctattggaagaaatggggagggtggcagaaaatgctgcagagaaaaggtgacacttggttaaggctttggaggctgagcagaaacttgccaaacacagaaatgcaggaattgctggtggtaggactagtccaagcaaaggcatggagcaaaggtactgcctcgtgcccttggggagctatttcagggaggctggaaacagagatgaaagcttctgcaggagccaacactcgaaggaccttgaatgccatgtcaaagggtcagagttctgtcctgagggctagaaggtcatctccacatgggaaggcatcttttttattggactgtcaggcacatagtgggtgctcggtaaacatgtatggaaataaaaaggagaatttcaaaggtatttaagcaacatgcttaattatctaattatctttcatccctcatggagagagacaaggtgcattccatgccagggactgagatccaggcttcattctggacactggagaggtggcacagacacactcagctcaggaattctttcctgggttgcagcccccctcctggccctgtgccaggtccctttcacctctgcccgttagagattgcttttggttgctgtgttgacaacccctgtttctgtgttcggagcggctgttcagtgccatttcctgatttaatatcagcgccagcatacagcaaggatgcacagttagcagtttttgctccaagtatttttcaagttcccttttgatgtaagggttgggtttgcagcttccctgatcacacagagcagggagggagagactgggggaaggaactgggagccagaggtgggagaagacgaccctgagaagattcatctagtccagctgagctgagagactccaagctccttctgcaaggggatggcagagggatcagctaagacacggcaggctgaagggtttcctggaaggtgtggcctctgaagcaaggctgctgttacccttctgtgtgggcataaagatgtacacgtgtctgtgaatatatgtctctgtcacaaaaacaaagggttaaaaaggttaaatgatctaacattatgcaattcaaagcacgaggaaatgaaaacaaaattggtccaaagcaaaacttaaggttggtacaggtcccagtagtgctcagtttttcagggtttggggttgtttgtttgtttgtttgtttgtttttgactgagcatctactatgcccaaggacttcctcagggctgagtgctcatcctcttctgatggaaacagatctttttcactacattatggccaatgcaacaagagagcatgctcggggactgtgcacactcaggaacacacacccacatttgagggcaggacacaaaaagagactgggcacttcttcaccagagtccttgaaggcctgcacccccccacctatagacacctctgtgacctgctgctggggctccattctacctcttctaccacccacctgttggactcttctccaagaccttctatgtcatttggggtcttctgagaagcagaagccaaaacaggattctatgtgtaagagattgattgggggacacacctgtgaagtataaaggaaaaaagggcaagaggaggcagggagagccttcagaccgtgatgttggtcttgcccctgtgaaaggagagggggaaggaaggaggatgtggaaggaagagtcttagactgcagcactgctctaggaaagttgcaaccaggatcatgccacccagtcatggcagacttccccaggtaatgaaattagccaagcaaacatcttcttgtgtgttttctacatgtgagggactggattatatttagattgcatcatctcacttagtccttcacaataaccttaacagacaggtactatcttcattattaccccattttgtaggctgaggcttaaataaattaagtcccttgccagagggcacaagttacaagtgacagaggaaagattcaaaggctgtttgactctaactattgctctggactgctgtggccaggaggaggcttggaaagggtaagtgggaggctcatttctctctttgcacccatctctcctgcttatgggccctgggatgtgtttcagcacaacccccaacaaggcttttctggtctcatcagggctgatgccagctcattccaggctggtctgccagtcagccccaagcagatggcccagaatgctcacctgaaataggcactttccagcagccacacatgtgcttttctcttgggcattacctcctccaggaagccttcctgctggctggcgcatgttttcatagcaccttatatagacactttgcccagagcatctgttatatctgtgtccaccaccaaactcagcctctctaggaccaaaaccaggtctgagtcatgtcagcacccagcactggagggcatagcactggagagacagcaatacatgcacctggtgcttggacaaaggaacgtgtcccaggggcatcaagaagacacccttagagagcatgggttgttgtcaggaaagccattgctttagccttcagatgtgtagcctgcactccctggcttggttgccaggggactcactaacccccaggcagtgttaacaattgagcttctcgcttctctgcagcagataacacctcccacccttgcctcaacttctcttgggggccaggcccaggcttatacccttgcttcccaaagcctcagcatctgcttggctgccagtggcacagtgggtagccccagccaaggaggagagttatttttatttatttcttcttaatcatgaacttaatttagctgctaatcaggttaccatggtgacttgcactggatttatagcagtttcctaaagtgcctttttcacactcttttggtaaatgaataaaatttgggtgatgcacaaagcgcataaatattgggtgtcctagaaaaaggtcagatgcatccgttttgtatttgccttttgccctgactaatcaggcacaagagagccatgactatgaaaagattccaggttcctctcctctgccctccctttaaaaccttcaatggatccctactgccaccaggtaaagtctgagattttttcagtgctttcaaggcctgcccctctatcctcccttcactaacactctaccttccagttctcctgtgctgtttcttgcaagcttttgcctctctgcttttgtttgtgctgtgccctgatctggaaagcccttcccggacagcaggaaagccctcagtcttctgagctctccagaagggttaattcctctctcctctgttctgggaatgatggtagcctggcttgtctgagaaaggttttcccccttgtcttgagaccactcccatccctatgtgctattttagaaaacctttgagcactcttactgtctccactattgcttggacaggggtggggggctatagtgctggccagcccaggagagtggggcagggaagcagcaaggagatgaaatgagcagttggcattttgacagctttccgtatttcactctgtgggaacctcacctcgtattctaccccagtgtttgggaagagagggatcatcccgtgggctcagaagaacttctgccttaggccttctgcaagctccccccacaccccttgtggctcccagaagggagagtgtctccaagctggagaccatagtttccaggtttcccttgaggaccttggggccggctgccaatcagtcttgggatcagccacaatccattagcgaatgctcagggctcaaggcgccaacagagccaccaggcgtcggcgccagatcctactcagggaacccaaagccaccttcaattattgtcttggactttgtaatcagacaagctgggcccacagaccataggctgttttcctaggctcagaaacccctccagccccagttctggcaccctgagctcaccaggtactctccaggccaggatgtacatgcaacccaacgagagaccactctctgaacctcctgggtcacaaaaggaaccacctgactcctttgcagcagcccacgctgtaggtaaagctatgtgagtacattaaattacctacccctctcttagcctcactttcccatctggaaggtacagctgtagttatggcagatgcactggcatcagtgatcatggacttactttacttctggccttctaaacttggagtcagaagaactgagttcgaattcttgctctgcacctttatttgattttgcttcaagattgaagccaggggagaggaaagggctgtttccagaatgcctttggaagcatgagatcagtaggcccagacatctacaatagtgaccaagaagggaacgtcttgtgatatgccaggcaagccctgaatggctgcacaatctcagcaggcaggtttgtccctttgtaccaccagaggagttctggccaaaatgactcagaggatctgggaatggggagtagacatacaactccctctaaccaagcatggaaggacccaggtatccagacccaatcacccaaggcttgagagagtctggggttctaaccctagctcagtggcaaacttactgtgtgatcttgggcaagtcacttaacttcactgggcttcagagagtttttctggagacatgaatccttcccaaatgagggtgagaccttatgttccccaaacccttctccagcatgtgagcttatgaagctggctctggcccatccaacagcagttgggggtgggggacaatatgactttgtaagaaaactcagaataaagcacagtaacccctccagccactggggactgccttactccacccctgcacatatcttaaggtgagaattaacaggtactcattcctgggaaggacttgacaagcatcttgcatggagaaaaaccgggagctcctcattgacttggtagatgttacacagcactgtgtttaagagcacaggctctggagcctgactccctgggttcaaatcccagctctgtcatttactacctatatggccttgtgcaagttgcctaacccttctgtctgctcttcttcacgtgtacaatgggactaatagtagcatttacctcattggattgttgggaggattaagtgagtagatacacattaagcacttagtgttgagggttgatgattatgtatcaaacatttctcccatgtattagttctcaaagctactattattagccccatcttacactcaagaaaactgaaatgcaaagaaattaaccctcttacctggtccctatgctctctgctagtgcatttgccatcagaccttgctgctcccacttctgctcaatatgatcaatgttctccactgacttgttttgcaaaacaatttcatatagcaatggaaatagagaagggagttgggagttaattagggcagggtgagccacagatcaattttaacactgttaaaggagagacaacttgacattagcaggtgatacaacaagaaccatcacaacaccatctacaaaggcttctagccaaaaatcgaatacgactctgatcaggcctctggatcaaactactgatttccaggaaacacaggggatggaggaacacgttaaacaacaccacaaggaggcgctcagctgaatctggaatgtgaaacaatctacaggagaatgaccaaaattcatcaagaaacaaatggcatttagaaaagagaaataaatcacatttttaaatgtgagaaaaagggaggactgttataaagaatattaagagacatatcagtctaatgcaatgtttacagcctgactctaaatgtaaaaaggaggttttgagacaattgggaatatttgaatctctaccaaatattaaatgaattggttttttcattgggttagatgtgataatgatattgtggttatgttaaaagaaattgtaagtccttatctactaacaatacctcctaaaatgtttatacatgaaatgagatgatgtctgtgatttattttaaatactccagcaagggggtgggggtcaagggtgcatgcaggtttatagtgattttctcttcttctgtatgtttggaaaatgtcataataaaaagtttaaactaaaaaggagggcagaggatgaaggcagatcactaagtatgaagagttgtaggtacgggtttcagaaacatttaggtaggtagtgagtgaggtttggccccacagagatgggactgggaaggcactcagcccctcatgcattctcaggtcatctgagggaaaataagcctttgcacaccactctggaattcatttgtttattcactcactcactctccaattcattgatccatcatccatccatcggttcattgtgcagtcaacacacctgtttgttgagagcctaccagaaactgagatgtaccagaaactgagaatacaaaggtgatcatcctgtccttctggcacttacggtgaaggcaggagagtcaaacgcttgttaaatctgccattacgcagatacagcttcacaaaccctgaaaagtctgaggtaggaagtggattgcatgccatcaagaagtttaacatgggcaaacaagacttgttctagagtcagagaaggtcggggaagctttctctataacatttaagctgagatttgaatgatgaaaaggagacagccatgtaaagagcccagggaagggcgttcaggcaaaaagaaaggcgagagaaaatgtcctggggcagaaaggagccagggattttcaggagtgttcagtatacaataggtacagcagagtaggaagcgagactcacaggctgggggacatctggggctgttaactgctgctcttgaaccaagagaaatgtctctcccatacacagaacatgtcatatagacaagaggcctcaggccagatgacaaatgctccaccagttatcaagacaggtatgggggaagtgcgtgtgcatgtcagagcactagagaaaatgttctacttcctgaaagaattttaatttgggactagggtggaggggaagggaagaaggcggccctggggcagagaagaggctactacaaagggaaccatcagaatcgctgagtaagtaatactcccaattagagatttaaaaaccaatggtgaaaagcaggcttgtgctcagctcagccctccctccctcagccagcctcagtcagggaaaggaagtcgtagccaactgtggggacaggtgcctagtgatttatggccctaagacaaaggctcccaaggaaaggccctgcgaaactcagacgtgttgttggaacaattagagcccatccatctatttgagtcagcacagcatctggaaaatgggcctggtccgggctgaacaccagctcttcacgtgggactttccacatggtgaacacacacaagaggccagtagctggtgggggaaaagccccatttttccgataaggaaaatgaagctctcagaaagaaaacttgttcaaggtcatcagctaggagattcaaactcagatctgttggagtcgcaaggccacactctttttggcatttcttactatctccctggaagtttctgcaactgccctgggtggctagtcccttgggggctactgggctctttcttcagttttccaagatggggctgctgttgcccctgcagaaagatttagccctcagatctcaattcactctaaaaagctaagctggtgtatccaaagccaatagcaggtccctctcctgcagaacaaaatgcgtaattcctcctctggaactgtgattctacagggacctggaaggggtcagtggtatcaggcccctgcctccaaactatgtgcagtgtcctgggcccttctaagaaatgcatgtcagaagcacccctcagggcacatgcatagccccgtgagctgattccagcagctgcacttcaggagtgctgtgtctgactcagctctgtgatcccagcacagcgtctgatccagagaagcacacagcaaatgtttgctgaataaaggaacagacctttagcattggagatatcgcagcaaacccaactttagaagaaaaaacaaaaggatggcttattaaaataagcttatggtacaatgttcattgtaaaaagtggatgatacaatcatatagcaaaaaaagtcccacaaaaatccagtatacatttaatagtgtaaagtaacatgcatatatttgtgcactgtgaaaattctagattaaaatgtaagccaaatattaacagtcctatcactgtgcagttggcttatgtgtagttttatttgcttcttgaattttttttccaaaatgtgttataagagcatatgctattttcataataaaaaggaaaagctgtaactatttttttccataacataatttttacatgataaagtttagggtgctgtctgcctctctgaattcagaggcagctgctgggtgccaggcaaggcaaagatgttgtgtgagctcaaagtcagcttcctcagtccacagaccccagggccacaggacccacactggcctcaggagccacccattccctgtatgggtccttggggtaaggaacaacatggatgccagacctcacagccatcttccaaaatcttaccacagccaggtacatttccacgactcctttctccgtaagcaagtcagtaaatcaaagtgcatctcgtacacaaggtgggccctttctggtaaaacacaaaaaaacttaatctttggtccagaagcagtagattgcggcagcaagtcagcagccaaaaccattaatctttgctgcattccccaactggcccgagtagtaaagaagataataccccagcagaatcagtgacccactacaaattggtcctgaaaggtccaccagcataaatagacttttgctgatccaacacttgttaggaaccccaacaaagagactattggctcatctgatgagccgcttgcaaggggcccttgcaatggctggtgatggatgaccaccctcccttggaggggaagatgcagctcctggtatggggccctttctcatcttaaatttgtcctcaataaatcacaggtgcagagaagccagcatcagtttcattacacctacatgctccagtatcaatcacgccaccatggcggcctgtctgggtgcagttcatttcaagtggctgtttctgtcctgattccatttccactgcaatgcacgcctccaaggggctggggcctggagaacgggaggaagaagcttttctgtaaaggcctatgcttccctggcctcagtacctattcccttctccttgtctattaactattccccaaatgtgtgtcacttggagctccagatccagcgcctgtgcaaagggctgaagccccaggatcagaaagacttgtttttagataataggtctgacatttgccaacttggagcaagtcattttactttgcagaggctcagcttcttcatatggaaaatggggctaaagacacctgcatctggagatgaaacacagaagtaattgtaaagaacctggcacaggctgggtacaaagtgggatcttcagttcatgtcagtcccagtctctgctcatccctggctgagatgctggttgaagagaaagtattgcagggatggctgatcttgctttccctctggtactcaggccagtgagaaagtggaaattctgttgttcctcttctctgtgtctacctgcctggaccattcctggtgccagcaaaagtatgtcaattatggctcagaatttatgaggatgctgccacagctcgttttttgtcttgttcctttcattgtaggcagttaaaatacacttaaaactaaggacaccagagagctctcagacctcttcttaatgcacataatcaaatactttaatgtcattaaatgcataaaggctcatcataaaagctgtgaacttcttttttaaagaatcataaatgggaataaatggtttctttttaggcaggtcctaagccagttcacctacaaccactagaggcaggacggaagcacccctccaagcctgccaataggcctcctccagagggcacagcccagctgcctctgctgtggggtggagctctcaaggcctagtggcagccctgtaaattgttaactaaataagtagatctttgagcagaagagaggggagtgcaaaggaccctgctcctgagctggtaaggaatgtcagacgaaacaagcttttcaaaaagacacttccattcactctaaacctacaagaaagccagagtgacagggccatttatttgcagaagagctggggagggggtggaaagggaagcagagataaggagaaggagcagagaaataagtaaaggagggaaaggcagggagagagagagaaggttcgcaaagcatgcagagagagggagacagagaaggagagggggcaggctctaccccagggtccagtgtctcatccatcaccagccattgcaaggaccccagtggttcagggtccaatgtcttggtactgcatgttggctcagaattctgagacagagcctacagagctgcatatatatccaatacatctcagagaacagaatataatagcaatataataaagatgatgatgatgatgatgatattgaacatttactctgtgtccagtctaatgtctaagttctttaccagcatgacctcatttaattctcctaacaacgctatatggtagctactgtatttcatcaattctaagacatacattttctttttcccattttaacacctctgaaattgagatgctttttaaaatcactatcagcctgccagcagtcttgatgtcactgtcatatctgggaacacacatcaaaacttgcggaacaagtatttgcagcttaaaatcctgaggacaatagaggagtgatttttaaagaaatgctatcacaaatgcctgcaatgtgacagcagatgatagtctgttgaaaaacatggacattgacaatgctgagttcgtctctgaatatgaggaagttttaggaataacttaaacaattatttcacttatattttccttttcatgtatgtatacaaaggtcttgtgacaaacacctatgtttaaataaacctgaaagttcttttcataagtataaaaataaaattctaagtgataagaaagtattatgtcatggtttcactggcagtgatttgactgttttttagtgtttcataaaataatggtgcaacatacaagctctctaagtcccatcttatagatgagcaaactgaggcacttttattacttgctcaaagccacacagatagtccaaactccaggtctttctgattctagaacctgtgttctcagccattattgatcttcatctctgacatctctgaattcagatcaacataggttctgattccagctttgccactttctggctttgtgacccatgatactgatgtctagtagtctctgagccataaagcagaaatgctaacgaaacctgcttctcaaagttatgtgtgggaaaatccgtatatgagaaggttcagcacagttcctggccccaagaaagtgcccaggatgtggcaggctgaagaagggtctacctataagtctgcgcacatccgaatccaaagaacacccacgcagcagcggacaaaagactgggtggcaccaagagctcagatctaggactggaactgtgtcagtaaaagatgcttttagcactctcaggacaagccagtctgtatacacttcctggtgcctgcaagatgctcaactcttccttcctactaacaaaacaacagctgcagtgaccgcaattagtgtattactttattattaccatttatatcttttgaatgcctacactttgggactgttctaaggcctttacccacattgtaatctcacaataaccccaggagtaggcacattacagatgaggggaaggctcagagagttgaagaacacatagggctgtctttgggcatcctaggctgattcagagaacaaatacgtccagtgtcttaggttaatttgatactttgaggtcccgtggttccttcccattaggtctgagattcaagttaagacgtcgacttctaaaagtcataaaggatttcttctccgctgccccacaccaatgataaataaaacatgtttaccgtggaaaattcggaaaatatttataacaaaaagacgtggtcacacataatcccattgcacagagaacacctcctggtttacatttttttgctccttttctcccattcttatttctaaccatattttacacagtttatgttattcatggaattttatatcttgcttttaactcctggcataagcatttcccacgttattagaaactcttaaacatcatttttattgttaccaatattgttgaatgggtggaccataaggtccttaaccactcccttcatgtgggagcatttaatgtccgcaggcacaaacttgtgtgcctaaatctttgcttacatttctattcctttgggataaattatttacaatagcattactgtgtcaaatgacttgtacatttttaagactcttgatagatattgtcaaattgtaattcatatttaagaatatctgtttcaacctttttttttttttttttgagacagagtctcatttcatcagccaagctgcaatgcagtggtacgatctcagctcactgcaacctctgcttcccaggttgaagtgattctcatgcctcagccaccctagtagctgggattacatgctcatgccaccacacctggctaacttttgtattttcagtagagatggggtttcaccatgttggccaggctggtcttgaactcctggcctcaagtgatctgcctgcctcagcctcctaaagcgctgaggttacagacatgagccaccacacccagctgaatattaacattttttattgttattctgataatgaaatttttctgattgttttcaattaacatattttagtttactagtaagcatgaactttaaaaaaaaaaaaaaaaccttattttacaattgtatctgtggatttgtgaggttacagcaaagcagttaggagcccctgcctgctagattaagctgagtgattttgaatcctggcccctcacttacaatatgcgtgatcttggggtgattatttaacttctcaaagctttattttgttttctcatcttttaatagggatgagaataataacacctaactcatagggtctttgtaaagaatgaatgagaaatcccttgtaaattatacctggcatatagtaagtgttcactaaatattagctacttgaatttcttttgcaaattctttttcatacccttttctcatttatctgttgagatcttaatatctttcttatccatttgaaagttatttttataggaagaacattagccctttgctacatatgttgtgaatattttctaattggcttttaaagcaacattctttctctcttgatggtctccatgagagtattttagggccatccacatccagtgaagctgaagggaagggttaggtctattcagtaaagatatagaaaaatgaagtagttttcatttccaatgatgcgccccagaaaacattgcttccattcacaatgctgcatttctaatagatgaggtaagaattgatggggtttgtcgtactcacaaaatgacgcccaagcggggatgcacggagaacgttgccacggctccgacatgttgatgccaaacactgcacgaagcacttcgtgtcagggaaagaagcattagagctttctcgagcccactctttctcagtttggaagctgtcctcatgttcacaaggatattttggtagaaaacctccttttccaggatctccatttgcccgtcgccacttctgtgtactcagtacttttctgtcaacgagagttccaaggagtgagaaagcctgtttttgttttcattttttatgtctattaaaaataaacatgctgagaagctgcctcttagtctctttatcaagccccaaatgacgtgtagcccttgtcaactccgcgttgacgaatgcaatcagcatttacaaaatcagatttgtaaggcatcgggaataaacttaactaagggcaggtttcccctccattgatcaaaacgggtttttgccgaatgatgggcagtcggtcggtccctcaaagtaagtaagcgtacaggcaggcaggatgctgtccccagcccacccacctgggcccagctcacaggacacctggcaggttcttctgctaagaaagccgagaagcccacctctttatgggtcggcacaaatggggtacatttcatgctgagtcaatttaatcaatacttttcttgctttggaaaccccgagcatttagagagagcaaagccacactacgcagtaaagcagctttaaattctaatgagcttctctgtgctaattaatgactttgctaactggaagctttctttgttagaaaacacactcttgcctttcaagatgacagcttttcctttcccgaatgtcttttattatcaaaccagaaagggaagtactttattcctctcattctgttagaactaatagatttttattacttaaaaaataattttcttttagtaaccagctttgcattttgccctataaaagctagaaagtgcaagagatcaatttctcctaaatcctacctgtcacccgcccggcaggaaacggagttctagagggtaaacacagcctcttctggaatagacacaacagtatgccccctcccgccccctcccattgcacagtgagatttggtaatttgcaaattgagcagccatcattattttttaaggagcaaacagggtctccactcctcactaggagaatgtggcccaatcatttgtctcggcaacgcacgaattctagagcacttgagaattcttagccataaagctgattactaagagagggatggttataaagaaaaaaatctttttaatctggggaggaggggaagggaagatgaagggcaaggaggaaaagatacatagagctcattgctggagttatcagcccgaatcagagcttgaactctaattttttgtgaatcagaattcacacgtgaatgtatgagtggaatttctctctctttctcttttctgccttgttgttgttgctgtctgacaagagagtccgtctgggtctctctgtcactatcgccatctctgttcctctgtcctttctgagtacttgatgaagataccctgcctggaaataattgcattcagacccctgagtcccacttaaaagtctttgggactgatcgagataaatcccatcaggcttttgtttccactcaaagtgcctccatcatttactagacgaattaaagtatcaatttctgtttaaacattaacagggtgatgccaaatattagttagttcctaataattctgagggattaaaaagataataaaagtaatagtccattacattacctacttcagcaagattgtaatgaacgtaataaattctggatcagggttataacaacttccatctatttaaaatgaatttgtagggttactttcattaactatgtatatggggaaaatgatctgacatattaccttaaaagagctgtaaaaccgattaggagaaaatatgctttccagacagggatgctggccactggggacaactgcatccttgggaagtcggaacgagctgccgagatagcccgattccgtccttccagcactacctgcttgctactctgaaaaaaatcatgacagcatcagcgctggtgaacgagggtgagggaaccttctttttccccttctccttttatttatttatttttttccttcccaggtatattcctgctaatgaaccagggctcactctgggaacttctgcaaggaaataaaccctaggcctgcagcccagcctggcctttggacccccaggggaaagctgccatattaaaggggcccatgccctcattgctagaggagacaagggagcgagcacttgactgcaccacagaaattactgctgtacctcgaatgcccgcttcatttatcaatttcatagcagaaaaacccatatgactgccttgttcagtcgcacgctaaatctagtcacagaaaactccccaccgccagtcaagtgtgttacgcacaggcctggataaagtaacttgaaataccactaatgatttatacttaattgaacttctaagtgattaaagtggcagtaatgaatgaataacaccctcctcattcccttgaccacctggcccagcccctccaggcagagtgggcctcgcctggggaagtcagcggggatggccgcctgaagccattctctgggctccccaacgctgctcatcctggctcaattgctctcacttgcagtaaatgactccataagcaccgaatcagaccattgatcctttttattagattacccaattgtaaggttaatgcatttgcatttggcaaacggagtcggtcaactcaaatccctagcagggatcagcgtttaaaaggacacatgtgggagcaactctgtcaacacacagatttgctggcagcagtagccagatgctgacgcccttccttcccgtggcccccccaccaaagaaggtgccataagaatccacttccaggcctgtgtcttccttagcagcagtcctcatgggacagccagggggccacacctgctgcccatgtcctccccacccccagtgcttctgtttctgaaagaaggaagaatcctgcaaaagttttcagtcaccacagacagggataaaggtggatagttcacctcgggccaggaaccttgctgccttctctaaatggaggagagccaggacttaaatcagtgacaaggacacaggcttcagaaaccaaaagttcttcttttctgatggtcatagagtcagacagggggcagccatttatacctaggcctctatacccgatgtgaatttattcttggattttctaaatgcattaaccaaatgctatttacgtggtctgccttcattaggattttctagtaaagaaattcataagttggaaaaacatactttgttgatctcatatgagttctgcgttggagaatatagccatggtttaggggaaattagaagttacccagagaaatcaccccagaaaaccatgtccttttatagaagaggaaactggggtgcagacagaatgaaacttacccaaggaccacccccaccacagtgagttcacagaaaaactcccgtcttctgccttccagatcaccctgatgggccatcctcgggtaagaaagcagtactctcagaagaggtggttttgaggctgtgacagtaaagaaatagtctttttatacaaatgtcttaagacacaagccatatttcatattcagctgcataaactaggtctttgtctaaattgttttgtggagtaagattcgctctaagtattgcttacaggatggatttgttcagcatcttgcctctgaggacaaggaagctggtttcatcatttccattctgttcactttttctgctgttcactttctaaaggtggccaggacgctggggaacaacccatcatgtgaagtcagatactgagggttcaagccccagccatgtcacttacaggccatgttattgttctgagcctcagcttccttcattgtaataattcctccttgctgaattgttttgagattaaatgggataatatacgtgaaaatgatcagtgcagatgaagctcttatctagatagggctccttatccatgagttttctccctcctggtttcatagaaaaagagtgatcccttgggctttacaggcagtaactgactggtgacaggtttcctagaaacagcccatgtcagtaaagggagctgtttcccgtcccagctctttcttgctttgcaagagaggcccaggcccttgccagcctttcatttgcctcctctgctgaaggctggaggctgtaccttctttgaatcactgctcagaacttgtctgagtctcacagggcctaagaggccatgaagataggggtagggcaattcctgtaacaacaattcaattacacttcagttgccataatcgtcattcacttacattttttgagtactcgtcatataagtattttttacatgtgtttaacctcatctaagcctctcagcaatcctgtaagattcaaatggccatgcccactttacagaagcagaaatcaaggcttgcataggtcaagtggcagtccaaagtgacacagctgagaggggacagagctggggtttaagctcaagccggtcagactctaggatccgtgctccatcactgtgccccgctcttaggactcacagcacctttgtggcagggcacaagccagatgtcagcagggaccctgacctatccttcctcttttagccagttgacccattgagccccagggacaggtatttgttctcagggaaagcagagcatcagaggagaaggggaaaaaaatccccaagtgagcaacagctgacctctgtgagttattgagaaagtgccgaggtggcaaggctggtggtgacagggccccaggggcctaaaagaaggatgcttatctgattgggagtgcatgcgggcagattctacctagagatagttgcggctgggctgtctgggaagagagggcaaagagaggccccagctggaataggctaccagtccagaaagaagttcccagcattagagcttgccacccaagaagcttcagacctgagcaagccaaatcccaaatccccataggccatgccatcagccgtggcctctgttctaaggaggacacacagaataccgggtgtaggaacagatgtctgtctatgcatagacatggacagactttgtctctaagtgggtctgtgcttgtctgcaggggtgtgtgtgagtgtgtgtgtgtgcatgtgcacgtatgtgcccacacagcatctgagagtgatgtgtgggacagtgtctctctgcagttgtgtctctctgtgaggatgagggtgggtgggcatgtgtatgagtgaccatggctggtcccaggactagcatctatggacccatggaggtctttgtgcctatgactcagctgaggtgaaggatgatgggggaacagttggtcccatcagtgggaatgtcatgattcacagaagtaggttccgggggaccgggaaggaaggatctgctctgtcttgaagagtcaggaagggctgcctggacgaaggggcatttgctacatggaaccttcctcctgagtctctcatgggctggacctgaaccataatgtgtggaaacccctgttaccacccagtcatatttattctgtcgtccccagagcagtttgagacaggccaagcagcatgatgggctgaggagttaaccagcctcttcccccgaaatacaaacacaaaccccccaccaagccctgtgttcataggaggagatgggagtaaccaggacagcccctggccacctctgactcctggacttggggctcttgaatactgcctggtgggtgtttccctgctggactgacctgattttttatgcacaatgcagaacagaaccctgtccagagttgggtactgcccctgtgaccagggctggtgtgggcaaccgagcttgactctgtacctctggcctggaggctgcagtgcctgaaacccacttctatcaccacctcttactgctgtatgatttgggacaagccctttgagcaacgtgagcctcagtttcctcatctgtcaggtagaaatgattatttcccccatacctcagtcattgatccttggtggctgtgcctcaaccacatcactaagccctctgaggttcagcttgctcatctgtaaaacagggacaataacagcaaatgagatcacgtggagaaaagcacttcaaaatttaaaaattatctggtgcttgagagaaatcacctgtgagatggaaagactcggccagattttcaattcttggctccatctgcaaccctggctggcatttcttagaggatgcaggcctctgggtgttgcttcagtggccaaggaggctcagacagagagctccaggaccccaaggacaggaaggcccatggacggagtctgccggtcagaaggcaccggcccgtggctccctggagctgcacagcaatgattcaggaaaaggctgacaaggatatcagcagcgtgggtttttttaatcctgagtccagagaaaatgcacaatcaggaataaaggcgcccaagagagcaaggagaaggagaaataatcagaattagccagctggcgggcagcacaaacaggggatatgcaaccccaacagggttggagcctgtgcaggaccagctgaggaggtggccacggattgggcaggcccagacaggcgcatgagggaacttgggctggctggagcccagcaagcaggcagaagggaagacaataaaagaagccgtcatcaggtgagtccagcaccctcggaggctgccgtgggcccccctggccacaaggcagtggaaagggtgctgccagagggcttcagtgctctgccccgcattgttcacgaagctctggatgtggacgtcgggtttcagagcggccaagagattgcccagatcctgtagaaaggctgcagaagcctctgcaggcagcaggccttcacacccccctccctcgaggctgaaaccagactaggatgacagagtccatggccctaaaatttcactggggctctctccctggcagttggacagggtgtatcaaggcatttagggaggtgatcccagggcctgctttaagaacagaaaggaatggattttgatgagctggggcagagaaatccatttccatgggcaatggaactgatgttgttcctaactgaaacctgcttttcacaaatcatttagactatcagatggcttaagaaaaagccctggtcctgagagtgatgtgtgtgtgtgtgtgtgtgtgtgtgtgtgtgtgtgtgtgtgtattgggagagggcagaattaatgcatccacccttgattccactgcagattccaaattaatggagtataaattaatgacaaacgtgtgtggcgtcctggaagcccagtgctactgtgacaccccctgattctgggtcctcaggcaaagtgcttccctgagctgctttcctactaatctgatatagaggaatgggaatgcatgtccccaaatcccccttgccatggccgggaccacaacatccattcagtccagcttttttttttttttaaccaggaaaggcctcaaattgaagatttgacagtgtcggcaataattatacagaattaaattgtgtgcgtgtgttaaaagcattcattggctaaatgtaatatttattacaccacaattttgataataccatttgcgcctctttttctgtgatatttaatattccagaagcatagataaataaaggaatcaggacctctctgaccctctaacctctgatcctcattcccagttcttatcatgtaggttcctttcactgtcactttgaggtaaattgggatcttaggattcaggagaagcctagaaggagaagagggttacttcccttgagcactgctgattgtccatatctctctgttaaaagctgtaaattacactgactgacacggagagcccggcagacgttcccgagaactaccgcaagctctcggcattactctctcccatcagagctgcactgtctctgggtccgtaactgagcaaacaccctcttgcatttgtacgcctctcctgggtgccaggtcaaggcaggaatcacctggacctctcacctccccagcccactctccatgggtcatctatatgaacatcaaacccaaatcacaagcccccaaatttaatttatttctacctaaacaagttcttttatcataaagcaataaatttgtcttggtgctagcaatttgttgcgggtgacataacattgcaaattgattaatcgctactgtacgcagcaaaatgagaaaagcaaggaattattatgaatagcgtccgtcttttacgggagggattcattattcaaaagtgcttgctggtgcttacatgtgccctgggtgcagattacatccatttgcagacttcccacatcatgcttacacaaatcaacaaacgtgcatttattaagacgtagaatgaaagctatttaaaagtgaaaaatggccttttgcattacttttcttcaaggaaggcaaatctgggtgggatgttcctgggacaagtccccacagttgtcacatgagtgtctctgggttctatgcaatctggctcatgcaggtgccaacaaatctgcctgctatgcctttgacagtcccaggatcagaaataccccaccagtgattttgcaacccttgctatggctcaggagacttaagcaattggctgtcactgcctgctggggaaatgcagcagagagttctcagttctccaaaaatgagcctccttaacttcccctgggagggggaaaggaaatgaatattaattgagtatctattctgtaccagacactatcctgaatgctttccttgcattaataaggcaagtccctctacctccctaaacctcataggattgttgtaaagaccaactgaaataatgtgtgcacataaagcacatagtaaatgctcaatatatattagctatgattgctattataatttcatttaagcattcctaaggtcagtattagtaccatcattttacagatgggaaaactgaggcttagaaagatttcaagatttgccaaatcacacagtcagtgagcagggctgagcttcaatttaggatctgcctccaacaattcatttttttgcaaaaccacccccacagctatccttgacagtcaaaataagatgtatttgcttcctctaatccaacagaggagtccacacaccaaccacacattagctacccactctttgccttcaggtgtgtcagaggggacatttgagagggtctggagatttcacggccttccccatctctgcccctagctgttcccgcataggtagagccctcatctgtctctgattcttgtcccttacttctctatctacttgtcccgttaccaaggacacttccagaaggaagcttgttgcctgccccagtgaaaggctgacgggcggctcacagcttcagcattgattattcctgctgaactcatgctctgcttaaaaatagactaagatctcaactttcatattctaattagatttcaaagcgacttttataaaacgagaatgccttcattgtttttctgctgcataaagggctattaaccgctccccagccaagctaaagtcctttctaatccctgatatcacccataagatgagaatagttactcatcagcttccgagaaaaccgtactgaaccacaaacgtgtctccaggtgtccagaatccaggggtggtcgggttagaagcctgggcatgtagctcaagctgagagttggcccctgtgagcatatctcacaagactacatttcaccaagggtcttcctccaaccacctgccctgagatcaacccggggcttatatgattctgggcatccccgagatctgccagactcatctggttgtgtggcctggcagtctgtttgacaaactccctgtaagatttgtttgcacactaaaatttgtgaactatcatcccaagtatttctcaaaccccatgcccagttttttatgccaccaaactgaaacattgattattgcaaattctggttgacttacaaatatccttcctcaatgaaggggagatatgacctaagaaggaacttgctattttgaggcccagttgactctcttcctgtcagctgtccccaccatagtcccacaaggcatccttgggctcctagcaagaccagggtacccaggctaaattaggctgtgagtcactttttgcatagtctggggggcaagaaaagaccagatgcccagacatgatggaagtgacaaggacatctctatgcaattctgggctctgtttacaacagtcagagccccaagctgtcaagtacctctgtcccaattgttatcacaacctgtcgtcttatgtgcccttgagtgtagttgttctcaaaccttaacatcagaatcacgtggaggcttgctaagacatagattgccgggcctcacctcccagagcttctgactcaataggtctgctgtggggcctgagaatttgcatttctaaaagttctcacatgccgctgctggtccagggaccagactttgagactctagactctaagctccatgttatatctccagtgttaagtacataataagaactcaatttgtgtttgcagaatgaatgaatgaatgagtaaatgattgagtaaataacatgaactaccttcttgagctctctaactgggactcctcactccactccacttcacttgtggttatccagcatctgctggacatctgtaaaagcatccaggaggtgtatgtgtcctggggccaggacagggtttgtggtttctcataccaacaaataaaaatatggcttgctcaggaggtcagaaagctatgcagggagtgaggtatcccatcctggccttgataagggtaatggtgactcttaccacctcaaaacactggcccataatgtcctaggtgggtgacctcaagctgggccctcagactccaaagagtctccatttccttattcatgaggttgggcatggataattgtcttcaggataactgtgccgattcaatgaggctatacatgaaaacagttcaacagtgtctgtctggcacatgtggggggcttggtcgatgtctgttccctcattcattccccacaacccctgactcctgtgaaatgagtcccagagatgtttcgggagtaatgaattccctcatttcagctaagccacccgtgatcctggttttgtagagatgtacgatgcaacatgataaattattgttttaagcagaggcttcattcaaatatccatttccctgtcaagttaattttgtttggatgtattttctagcgggttctgactgggagcacggttggtacataaacagaagaacattatgtctttggcccgttctctgagtgacagggagctgatggcaccggggagggaagttttgtggattatcacggccaagaatccccattccccagacatactaagttggtggcatagctctgagggctaattgtagtcagttcacctctgtctgcagagcatagcagcacctcatctctcctcaaatggctgagttcctctaggaggggcatatttcctaggaacacccaagaaggtagctttgtttgtatcagtctctagttaagccaggagccaaggccttggcttatctcatttccccctcagccccagaagacttcagggtgaatttcccaagaacaaggacattttcttacataccacagtaccatgatggagatagggcaattaacatagatgcagtactgttatctagttcacagtttatattccaattttgccagttctccaaagaatgctcctcatagccatttattttctcagtttagggtccaattcaggatcactcttttgagtcctccattctggaactgttccctagcctctctctgccctccatgaccttgacatttttgcagagttcaagccagttatttcatagaagataactcagtttatgtttgtctgatgatacttcatgattagattccagtcacgcatttttggcttacataacacaaaagtgatattgtatccttctcaatgtgttctacttgtcccactggtgatgttgacttcaatcacttggttaaggtggtcatccctggtttctccaccataaaaagattattttccctttgtgatttatcagtgatttgtgggaagatactgtgagatgatataagtatccttgcacttgttttagtctctattgataattcttgcctaaatcaattatactaggatggttgcaaaatggtgatttttccaaatccatcacatcttctacatttctgagtgacattatactgtaaaggagagtgttcccttctccccatctatttatgtatttatttatttatcgctaacactatgggctcagagattcttcttttattcaatgtgctataatccctatcattgctaccattgtttgatgcttcagttgcatgatctcattgaatcctcatgacaattgggtggtatggcactattatcagagatgtctgcatttccaccttaggtcctgaagctatgtcagcaaggctctgattcccaactcccagacccaggctctgtcctggaaacactgccttccctgcagggctcacataggaagacaagagcccacacataatgtcaccaagcccagacttcccactaagcaccatgggaatgaccctacaggatagaagaagcttgacttccctagcgttctcttgctctgtctgaggcagctcagcctggaggcacagaggcagttatactgggctgtctagtgacatgatgtccccagtgactcttgacacaagctactttttgtaactgactggatgatgagtttggccactcctaaattcatcatttgacaaatatttgctgaccacctactatgtgccaggccctgggctagcctggatttacagcaatgagcaagtcagatgaggttcttgttcatggagcttgtattcaagtgaaataaactgtaatcaaatgatcccccaaacaaatatatgacaacaatagggatgaggcctatagaggaaagaataattatgatgaacatccccaacagggggatttgaccttgtttcggacatgagacagcagattaaagtaagtggtttaaaacacactgtttgagaccattactcaaagtggagaaaaggaagctgagactcagagaggttaagtaacttatccaggattgcacagtattggagtccagactcaaatccaggtctgctgactcctcagcccaacactggtgcagctcttccaccaaaggggttccttaagggtctccggtgattccgggcatagggcccatgtccatctgtttgttcaatttagcatactttgtttccactgtgatgctgtgaggtcttgctaaggacagccaggggataatgactttctgataagcccaaacattctctaaatcagttttgatttatttttaaggactaaagccaagaaaactgaataagcctcaatattaaaacaaggcaagtgaatgtatgcccatcactggacatcagagatctgtaactgtgcatcaggctgtgagctaagcatagagggaggctgagagtcacccaggtaggtccaaggccagagcccatgctcttaaccatagcactgggctacctccctggagatgtctggctggctggctgtccatctgtctgtctgtctgtctgtctaggaggctgcaggcaagtccttagccctgggagcggcaaggcaaattccaagaagaagaaaggatgcccatgcctgcccctgctgctcaaggaatcaggaagagtcgaggtgggggcagctcaagctcatgcctgcaccctgctacacacccacaccaacacccccagcctccaggtctcctctggctggccttggcaggtcctggcttgatacctgatccctgtggaagctgacacctcagcatgagagggatcagggcagacaccgctgccgccacgggagcctcaaccgacttcagggagagacgctgaggacactggcctgaaaactgttccctctcactccacactcagagagatgcatgtaaaaattcttatatataataataataatggcaggaaaagaaaaagtttccagttaagtgacttgactgagtttacacagctgggaaactggactcaaaatccaagtcatatgttttcagagtttatacatttaaccttttcttcaacaagccatctccttgtataatcaggtaaatatacttgttcagtgcctggtacatcataggttctccataggaatttgtttaatgaccacatgtaaatatatgtatacctgtgtttgtgtgcgagtgaaggtatctgtgcatgtgagtgcacatctctgtgtatgagtgaaggtgtttgtgcacgagtatacatgccggattgcatgtaatgtggatgtcttgagtcctgaagttattacagaagattcattaagatcaggaacaaagatgcatgatagtccttttatctcagctcttgtttatctcacgctttcccctctggaaacagagaagagcataaacaccattccattcagctttaggatagggaactaatagccaaaaacccacttgaggcatgacatgattggcaacttgatggaactaaaagaccacagctttggagccagacaaacctgcttcatctcctggctccaccacttaatggggcttaagtgaccccgggcaagtcacttcacccctctgagctgctgattcctcacctgaaaatggacatgataatacctacagtgtggttatgaggattcagtgtagggaaatttcccagcacagagagtctgataaatagccggctcttggcataccttaggtcccttctttctccttaaagacagtgtcatagtggtcatcttagtacatttgtgctgctataacagaatgtctgaacacaaattatatagaccagaattatatatgaacagaaattacatagaacagaattaaatagaacagaaattttttcctcacatttctgggggctgggaagtccaagatcaaggcaccagcaggcttgttgcctcatgagggctgttctctgtatctaagaggatgctttgatgctgtgtccttctgaggggagtgttcctgaggggaggaacactgtgtcctaacatggctgaaggcagaaggctggacactgagggaagtctttttttacaagggccttataagcaaaaggaaaactatagtgtcttggcaccagtagaatgatgattctcaacctcagctgcatattggagttcctggggagcttgaaaaactcctttgtcttctctcccccacctccccaagaggttctgattcaatttgcctgaaaggttgcctgggaatcaaggcttttaaaagctgcccaggtaatcctaatgagcaatcaaggttgagaacctcttgtccatagggcctctctaccatttattgagccgctcatggggtcagaccttggacagcctgctttgcagccattctgcttggagtttgctttgtcagcttaagccatggcagagggaggaagagggagaaacttacaccatctaaggctaaaatcctcttatttaaattggagtctgaatttccaaatcaaaactggagattcacaagataaataagtgctagagatctgctgtacaaccttgtcccttcagttaacgatactgtattatacacttaaaattttgttaagaagttagatctcatattatgtgatcttatcacagtaaaataaaaattttttaaaccctcaagactcttagtctaaccattttttctaatttgtaaatgcattaatatgcaaagtgttttaagatataaacatgtcttagatatacatttagctaaatgaccttgctaaaataaataaaaaccattcgacccactaatatttagtatgtgctatgtgccagacattttacctgcgatattctctcaataattgctactcactacaccctctgagtgtgctggggctggtaaggatggttatgtaaaaaatgcagcatttcccacctttcagacttaaactcctagtcttttatacataggcctctccacagatttctgagtcattttggaatttgcatgcaaaataaaagcttcctacataattgaaattatggtcaattgaccatgaaatggaagtgtccgtgaccaatgaggtgaggggaggttgttgtgctcataaatggggcctccagagccccagggccagttccctggctctgggagagaagcccacctgaatccagcttgttgtcctggccagcccactgcctttccttggtccctctctctggtgtagctccaataggagacattctgctgtactcttttctgtcttggttgagaaatcctctagaagagggcaattggagcagaaatgtccatatggaaatattttcctttctcaggtgatggttttgcaagagaaggaactgatgagccagactagggtataggatacccagagagagagagtgggagaggatgccagaaaagtagatgcagcccaactgcagataacttttgggatgcattgaagagccatcaaatgcattgaaagggaagttattttatataacctgcattttacaaagatcactctgcaaataggatttgaggggagcagatggaggcaaggagcccagccagtcagcttcaatgacaatccagccaggatgtcatattgtcatgaacaatagccatgggatgaaggaaaaaagaaggtagaagactcggaatgtgactaatagggacacaaaaaagcgaaaagaacatgtgctaggtaatagctaatatcacagccctgttagaaggtactgttatcatcatcctattgaaggggaaactgaggatcaaagaggttacatgtcttgctaataattggtacagccaggaatgaaatataggtccatatgtatttctatgttaataaataggtaaaatattaaggaggggacaaaattttgctctggtcaaactatactcagtgtactgcattcagatccagatccctactttaaggagaaactttgattggttaatggaatatatagagagaagagtgatggggcagtcatggagctgaaaactgtgttgtgtaagatgaaagttctggggcatacacctgaaaaacagcagaattggatggcatgtgatgctgtgttcaaatattttgggtccttctgaagcccagggagtgagcagaaggaaagctctgcatgagtcagcaggagccagaagagacatgttttaaacttaggtctttgtcttgaagacaatgggaagccattgacagtgttaagcaatcagtaacatgttttcattttgaaaagatcattcttggaggtggatccaagaacaccttttttgataaattgtatgtttccttcatatgtattccagaacatagcctggtaagtttattacctaggattttctattttttgttattgaaataaaatctttgtccattatattttctaactggttgttgtttgaattttggataaattttttttgtatatttattccatattcagcctccttaatgaactctttttattacttccaattctggttaattctgttaagtttctgaagatgataaacacaccttctgaaagtaattataatcctctctttcagtagttacaagttgtaatttttttcttgtctcattgcacttactagaatttctaaaacagtgattctcaacatagatttgttattctcaagcagggatgattttgccccctagggggcattcagtaatgtctagaggtatttttgattatcacaactggggaaatgaggcctctcgtggataaggggcattcttaatgtcaatgaaaatgccttttgtatttaactagtatctatggctttggctgttagtgtaaggcaggaattttgatgagtagagactttaagcccatattaattaagatttttaaaatcagaagtacatatggagtcttatcaaattattttataattttcatcaagatgataatattgctttttacatttgtcctattcttacattataatagttgacttcttggctccactgacattactttagaaaatcattgaccattgttaaataagcatatctctgctgtttctctccctgtcacacactgtaaggaattgcccatgtgaaaagcagcttgattacaaattaatgccagtaatttggagtgtctgcccttgtggatttcaatggggactcatatatgaagctaccatttgtttcctctgagttgtaacggctaaatatggataccatgagcctctcgttgccctcagctgctctgaagaatgactgataacctctttgaggtctgtctagattctcactcccacaaagtgattttttttatacaccacagaaacagacaatattagggcaaacaatttcaaacacaccctcacaatttgggggaaattcactcaggcatgtttgcatgacacagtaaaaaacagaaacttaatttttagtatagatttcctaatattaagctatctttcagtcctgaaataattgtgtgctcatggtgaattattatcttaagattggacttagtatcctaaattttttttaaatatacaacattcttactacattcaaaagtaagaatggtctcaagttttctgtctttatataattttggtatgaaattataagaattttgctatcccttttatgttctaaagcagtttatcatgaaatttaaatatttatattataacttagaaaagatgtacctataaaactacctggttattggtttatcattcttagaaactcactctgtaaagttaaataccccctttcacttccaatgttttgtagtaatattttgaccatcttgctagttgtgcaagagattttattgacatctgtggaacttctcttgcgtttagttgtaaattgtattgtttctcatttcttcttcttcttactattattattattttctttttgagatggagtctcaccctgtcgcccaggctggaatgcagtgacaccatctcggctcactgcaacctctgcctcccgggttcaagtgattctcctccctcagcctcccaagtagctggaactacaggcatgcaccaccacaccctgctaatttttgttttgttttgttttttgatagagatggggtttcaccatgttggccaggctggtctggaactcctgacctcaggagatccacccacctcggcctcccaagtgctgggattacaggcgtaagccaccacactcagcctttttctctcatttctaaattatcacttcctgcatttgtccttgaatattgctttttacctattgtctacctttttacctattgctttttacctattgaaaatatacattttctcttaatttcttatgtaaattgttcttttttttttattctttctcattttaacagtgaattcacttaaggaaatgtatttacctttgagtccagttttagccatatcccaaaagtttgctaaacgatgttctcattcttttcgtctaactatcccatgtctgctggtttaagttctttctaactcaaaggttttgttttcctttccattaattaaatattttccctctaaccttttcttattgtttcctatttttattatatggtggttagagaatttaacatataacttttatttggggaaactgttgattttttttctttttggctatcatgtaaacaatttgtattaatatatcaagagttcttgaaaagaagcttcttctctagaatatagtctccactctgggttgtgcatcacagagggaacacaggattatccaatagagtataaggaaaacattaaaacttgcattcaatatttattttcatcatgtcccttctctatttttgtatatgtttcatgtatcttatattagtattatagaagattaatattattaataatatgcactattgggagcatatacttgaaaaggttttaaacagagaagtgcatagtgaaagtgatagagactatcagtctaaaaagcacagaagtcaatattttaattcagtggtatgtctaaataattaacaaatatatttatatttaaactctatgctcaaaatgttctacatattgggattcacattcaaaaaagtttggaaaaaattgcattatcaacaataatttcctaaagagatagaaagcctttgtttatcagaattctaaggaaagcagggaaactaatttggattcatagggactgctaggctgaaaataatctaccaaaacagtgggaccagactctacctcctatttaaacatcacagaaacaaaaaggaagtcaagagaagcaggagaaggtgaggtcaggaggttttagggagcatttgacagccctgagccatggaagtgggagtaaattggaaaaattttgcctaaatttccaagggtcaaagtacatattgctgaactcctaagtatccttatttatatttttggtctgtgttaaattgctctgctattattgtgtttcatcacttttttcctaatgttatgttatttggcacatcaagattcctgactattatttttctttttcccctcccccttttttttattatactttaagttttagggtacatgtgcacaacgtgcaggtttgttacatatgtatacatgtgccatgttggcatgctacaccccttaactctccatttaacattaggtatatctcagcaaactatcacaaggacaaaaaaccaaacactgcatgttctcactcataggtgggaattgaacaatgagaacacatggatacaggaaggggaacatcacacactggggcctgttgtggggtgggggaggggggacggatagcattaggagatgactattatttttcttatggattgcttccttatcaaagtaaaattatcttctttttttctttttctttttcttttttttttttttttttaagacaaggtctcactctgttgtccaggctgtagtgcagtggtacaatcatggcttactgcttcctcaacctcggagcctcaagtaatcctcccatctcagccacctaagtggctggactacaggcacatgtcccatacccagctaattttttttattttttatagagatgaatttttgccatattgcccaagctggtcttgaactcctgggctcaagcaattagcctgccttggcctcccaaagtgctaggattacaggtgtgagccactgtgactggccaaattgccttctttagcactttgggaggctgaggcgggcggatcgtgaggtcaggagatcgagagcatcctggctaacatggtgaaaccccgtctctactaaaaacacaaaaacaaattagccgggcatggtggcgggtgcctgtagtcccagctactcgggaggctgaggcaggcaaatgacatgaacccaggaggcggagcttgcagtgagtaagatagcgccattgcactccagcctgggcgacagagcgagactccgcctcaaaaaaaaaaaaaatgtcttttacgttggagtctatcttgtccttgtatgccattttgacttaggtctaaatcatgtacaatgtttgtaggtggtttctgtttgcttgcttgctcactctcttgcttgcttactttaatccaatttgaaagtctttataatttgcattaaattttattctatttaaagacccaggtccacagaggaggtctacagaaaaaaaaaaaaaatgaaataaaaaataaaaataaacaaaaacccagagttctagatcttgctgcattgttattttatactgttcttgtgcttgtttgctattagttttgtttttcatcaagactatgactgtttttctaaattttgaaaaagtttgaaatataaaaagcactagaaataatatacaaaaatattcccataaactctgttctctttgatttttttcttctctggctgattgcagtgtataaaaccttcttatattcccataaatgattgtcttttcctggtaaaaactgtacttgaacctgtatttttctgttcattaatgtaatgaattaaatcatttttgttgatgactcttctgtaaaaggagtaaaaaagcatttttaaatttaccccaatccattcctaacccacttacatgttttcattaatataatctagaatttttagacccagattattaatatttaattttatgtttgtttatattatgttccactattccaggaattgtttctcagataattgcattgctaggtaaccttatttatggttattaaaataatagatatgtttaactgatcttaatgttcactgttctgacttttatgttgatttacccatttctctgtcctcaactttgattcatttcattcatgtgtaatatagcctcaagaattttatttgcttggctttttgtattttaggatgggctcataaatgatatactttgcatatatatctttctgttatcttcacaattgaacaacttgactgggaattgtatgctattgagtcataaccttttcctctcaaaattctgtagacatcgtcccatcatcttgcagttttcagaattgtggcaaagtctgaaagcaatctcatctttgtcctttatgggaaaatcgtttccttcctagatgcctgtagaggtcattcatttattaatacaggtattcaacaaatatttgtcaagcacctactgtgtgcaaagcactgacctagacacagcaatgaatggaacagagagaatgaagaacagagaatcaaggcagagagaaagaacagagaattaaagcagagaaaaagatctgccttcagggacctctcaggctagcgggggagagaggcgataaacaaaatgaataaatatgacgtggactatctattatagggaatttctgatgataacacatgttaggaaggttaaagctgaagaaaggcataaggagttggacacatgaccatttaaatagggtcctaagggaacacttaataaggtaacattccgataaaaacctgaaggaactgaggagtgagccatgtggctttctggtgaagagcattccaggcagagggaagagcatatgcagagatcctgaactgagggcttgcctgatatgttcaaggaataatggggaggccactgtggctggagtaggaatgagcaagagagaaagaagaaactgatgagatgagagttataatggaggatcagatcatggagaatcttgttaaccaatgtgtacacaggtcagcctttcccaagctggggttccagggaaaacacacattgagcattgctactttccaagagtgagctatgataagcaaagcttcccaaattaaattgtctatggaatcccgttatagtagacctgtcagtattcattcacccatgaactcaacaaatatttattgagcacctactatatggcaggcactgatctggcatggaggatacaatgatgaacaaaacaaagtccctgccctcatggaattttcatcaatgtgtggataacaaaccacacacccctatgtatgtgagataaatgctatgaatgaaaaataaagcaggataaaatacttgtagaacactcgttttgctaaacattgatctcttttttttatttttcctaatgtatgactgacctttcaataaaatattaaaatttttcttaaggttgtgaaagttctctcctagttcaccttccactgttacttcttttgttgttctgatctcttttaaaattttgtttttattttgaaattttggagggaaatattttaaagtatttattatacacaaaagaatatacacactggtctcctttttaggaacagcagtgatctctatgctggcactctattaagtgccattctctgttctctatgtacctaatctctttgctattgtttctcctatagtctgctagagtttttcaagtttatccaagatttatgattccaagtccaatgcccacttcactattattagttcaaatgcacacttaaaatctctaaaaactcacttttttgtgatcacattagttttttatattgtttttaattataaaaataatatctaatatttattaaaatcatacctcatcccagatactctgctaagagctttacatgctttatgtcatttactactcaaacagctccgtgagcaggcaccgcggttatcaccactgaacagatgatgacattgaggcatagaggcatacacattaagtgattattgactattttctaccttgccaattctgctctgtgctgcatctaacattgattttaactttgcttatttatatttcatctttatgaatttcatttaccttattttatttctaactcctctcagcttgctcccttcatgtcatccattgacgtatcatcatcttatttttatttcttgaatcataaactacatatttccatgaattttgcagaaaggacaagtcagatgtgttctaaaatgttcttcagtttactatcatcaatcttttttaaaagtaagttcttcctctacgttgtgagtaccgtgttctctgttttatgaggcagattttctgtaaagcctcatgagcttctttttttcatctatttactcatttctgatccaacaaaagaaagaaaataaagacaagtctgcctagacataggacttttctgctaaaaaaaaaattaaatgaaaaataagactttcttcggttcttctttgctggccatctgggtgctatttgaatccttaagcccagaaattatgccagagagctggcgcatgtgacagcctccaaatctctctacaacttccagtgtttttagtctaatatttactataacttcgatggttcacagggagtgaggctgtctcagaaaccagccggctgatcatgttactataagaaggccacatactcctgaagaatctgtgtgaacagtaaattcaaactccaacccctgaatgcctgtgactgtctcaagattagctccttcccaaagccagacccacatcccaacatggccattacctattgtatgcacttccaccccagtgacattagagtgctggtcactgaactgctggaagagcattgctagggtggagtgagggaatctagaaccctggcctcctcagaacataattcccacagagtaggggtgaggaatgcttccttctctctgaaggactcatttagagatatagatacaggttggggttggggagactgaggctgccttttgccttttccctatttggccccaccctctgcctcaatacttcatctgttttggttgaaggaaattagatgcatatcacagattactattccaggatcctggtgctattaaacatgtcagtatttgtgtgtttccataaacatttcagtggaaaggaagggaagacaaaacaggggtgaccaacttaaagagaaacagggagacaagcttacaataggggatgggcagctctctgcctcagtcttcccagacctctgaccttgctgtattagtccattctcatgctactaaaaagacatacacaaaagtgggtaatttataaagaaaagaggtttcattgactcacagtttggcagggcttgggaggcctcaggaaacttacaatcatggcggaaggggaagcaaacacatccatcttcacatggcagcaggagagagaagaataagagccaagcgaagggggaagcccctaataaaaccatcagatctcatgagaacttactcacaagaatagcatggaggaaaccactcccatgattcagttacttcccaccaggtccctcccacgacacacgggaattatgggaactacaattcaagatgagatttgggtgggaacacagccaaaccatgtcacttgtcttacccctaagttaaccctgagcagagcagggactctcttatccccatcacagatgtgtgctgggccagacacagtggctcacacctgtaatttcagcactttgagaggtcaaggtggacagatcacctgagtccaggagtttgagaccaacctgggtaacacagtgaaaccccgtctctacaaaaaatacaaaaactagctgggtgtagtggcatgcccccatagtcccacctacttgggaggctgaggtaagaggatcacctgagcttggggaggtcaaggctgaagtgagccatgatcgtaaccactacatttccacctgggcaagagtgagcccccgtcttcaaaaaaataaaaaagatggatgctgaaagtgtggactctggaagtaggctgcctgggtacaaatctaaggtccacactgagcaagttactaaatctttctgtgcctcagttttcccatctgtaaaatgatataatctctctgatagttattgtgaggtgtaagtgatataatatttgagaagtactaataacagcacatggcacataaaaatgctattggttgattaaatgattgattaatttaaaagggtcagcactggtacctacgagcctcttctaggcatgcatagtctgtcctcatgggctacttccttgatttcctttactgagattggagctctgcttatggagacctgctttgcctgtccctaacccctggctaggttctgtcctcgaggtttgggctaactccttgtccccaggatccacaggatccttgatgagtgaactttaacgaaaattaaaccaagtaccaaaggcttcctatgtgccaggccttcagtactttgcctgcataaatcttttaactctcacaacaggtcaatgatgtcagtgctgttattatccccattgtacagatgaagcaagagtcctaaagtttcagggctattaaacggagatgggattcaacatgaaaaacctgaagggcatagccacctctctgtctgcagaggagagagactttgggagttctgagacaggcctctcttttatgaagaaatttctaggcaacttaaagggtcccaaacccagcatggatctggtgctctgtaaatatttattggagatttatagagtaaaaagttttgccctagatcaatgattctcaacagggtgcgattctgcccccgagcagacaattggcaatgtctagagacatttttggttttcacaactggtggggaaatgttactgacatctagtgggtagagaccagggatgctgctaggcatcccacaacacaggacagacccccacgacaaacggtaatccaagtgtcagtagtgccaagaatgagaaacacaaggctctgaaatcagctggcatgttcgtcttctccttatatctctgagaagacaaaagaaaccagatatcccaacccggcacggtggctcacgcctgtaatcccagcactttgggaggctgacatggggggatcacgaagtcaagagatcgagaccatcctggccaacgtggtgaaaccccatctctactaaaaatataaaaattagaccggggtggtggtgcatgccccaggaggctgaggcaggagaaatgcttgaacccaggaggcagaggttgcagtgagccgagatcatgccactgcactccagcctggatgacagagccagactctgtctcaaaaaaaaaaaaaaaaaaaaaaaagaaagaaggaaagaaaaaagaaactagataccccaaaatgccataatccaagaagggttctgcgccttgtaatttacctctgtaaatagggctctctctgtgcctttcatcccccaattcagtcatctccttatttcttattttgggggcaatctcagaactgcccgtgaagacaaaaaaaattgtgaatttcaggaggagggtggaaacctcgtcctttgggaaaattgagctgctgaacaaaaaactcagcaggcaagcccctcatagctcacagaggatgaagcatagaatattttaaatttcatccagagagaactgactttctgctccttccattcaagagcttttgttttgcatttaaatgacaagggagagattggggagaagccggcagcttcagcctctgtgaggagggaagttgtcgcccctctgaagtggctgcgttaatgtcatgtcattacaccgtattgctgcacaggttaatataattgggtgacgatgtgtgagcaatgatccgtgccatgttacagctctgaaacaaatgacatttaaccagccagtctgtaaggctccttgttatctacatggtgagcaattgaaacggagaagcagacctctcgatgagcaactgataaattagttgttgggtttcctcgacagcctggatttataagagcacaattctaacataatttattagatctataaacagacagatccaatgtttttactgagattacatcttgtcaccctcagatattgtgtcgctgacagccctgttataatttatttttattattctgataaggtgttgtttccagggatttatttatttttccccctaaaaagacattttcatttttagctggaaaggaatcagaaactttaatgctagcagatctccagtagccacccagacagcttttccatactatgactgtgagcttctaaagagcagagctgaagttttagcatgaattagtgcatggcccttggcctggggaatggcaggaagacataagggagaatctgtcgggtggcattggggcctgtttgaggatcttcctcttgttgaaacatcagcctgtgattgatatccttccatagagtttctcacctttgcaggctgcccgcctccctccacacctgcctttcaggccaggcagggcacagaagagtctttcctggctctggccatcactcacctgagcctgaagctaacatgtagcttcctggacaacagtctcccacaaagctattctaagccagctcctcctgaccatgtaaaaagaggggtgcgtgtctactctcaaagcccctctaggcaaagggtcacaggtctgagtgaccaacatctaccagtaaaggacagtggccttgccaagaactgcaagggagaggcaatgctggagttgtatgtccagtccaaagaacacagatggtgagaaaacaccccacttagaggcaatcagattagggttgatatccctccaggtagctgtgacttcaggcattctacttctcctttatgagctattgcccatctgaaacatagcagtgatgacacctgcctcatagtcctggtgagaataaaatgagataatgaacatagagtgttgctttattagctaaagtactgtgcaaaggaaggatacctttattagcattaacatctctaagctctagagatacatttttttaatctggaagggatatttttaatgttgttttttattttataataatgataatcttcatatagctttaaattttaccaggtgcttgcatatgatataagataacaagatcgttttcatctccttataatttggtgaagataggtgacttgtttgtctccattttatggataaagaaactaaggctcatggaggtaacccagagttagtccactggttacaggattctaactcacaacagaacaaccctacatccattactttgtacttccaataaaatcagggctttctctgctccaggttcaaatgaagcagagcatggctctggggacaatcagaatgaaagtttgtcaccagctccctgttctcgagagttcagtcacagcttgctcataggagaaatgatttgggtcaattcaccaaaagcctggggtacaggtgctctagggtttcagctccactggctttcagggccagcttccgtccccaaggccagaggcaattcttggagtcattcataaagccctccatgtctcatggggagaaaagaaattaatatcagaagtggcagcatctaagcggcagcttcataacaggcttgaacctcgacatcttggctacaactgggaacggctcagccaagcacgtcattgactcccagagtcctgaacccgagatgtgcatgtgggcttgtaggtcacccagtccagcccccttattttatagatgaggaggttgtattccagcgaggggagagggctcacccaaggtgacacagtgggtagggggcaaaatcagggttggaaccaggtctcgtggttcagggctctttccagcattgggttctgcatcaggcatactctatcattggaagcttttatgagacccagtaaaacagaggctccatcaaaacaccaaatacgcaatgtgcaaccctgcacagatctgttaagccatcactgcaacagcaggagctctacctgggagggaggcccataccccatcaccattcaccccccttggccttgaacctcttgcctcaatccactgtgaatttcagccctcccttcctttcccagctgcagcctgatcttactcttaaggcttaatgctaagatgtgctgattttctggatctctttctctgttctcattaaagttttccttccagaaaattctgcctcaggccaccctggtagttgttctccagcctcatccgatcctcaagaccctttcctaggagtggtatgggaagaaaaccaaagctttcaaaatacaatgtcagctgaaatattgcatcttcagggaaggcttccctgaccccaaccacctccactcaagactggatccgtttctcacatcctttgcaagcagctcttagtgtttgtaaggagacttgggtgtgatttctagatcagcacgtgtctcccccactagagggagctctgagaggccagggtgcagctgcttttgtttgctactgtgtggccagtgcttgtagggtgcctgccaggagataggtgctccataaatatctactcaaggagggggatgcagatgaagctcgtcttcacccacctccaaaatggtgagcttttcctggaaagtggggaattctgggggcccttggagggtccaaagaggatgcacctttaactaaagggatgagttcatctttaaagggagagtttgggctgagacactgaacaaagtgatagcaccctgtccccacttctcccgtagccctaaggatgttttatgttgcccatagctgaaaaagtgccccttgtggtggtgggtggtgggcggggtgggggggcggttaggtttactcaggatggaggtggctacagtaagacgtcacctcctctgtgcttcccaaagttgcttcggcttccagggtcacctgcctaaaacctggcagcccatcaaggcagaggaggtacaaggcaggagaggtagggcagcccggttcctgtgggtcggccaggaacaagcccagccaccataaggaacaggaagagaggcccctggatgcccccaagaggctcctctggagcctgtctttgggtctagagggagcagccatgagccttgggacccagcacaggggctgtatctaggtgccaggggtagcagatcagcagaaacttccaggagtaaccaaagttgcatctgcagtcactgctcttcagaaacagctgaccagggtccctgaggacacagttctcacattctgggcaacaggggaagggatggcccatgcctccaggacctagcaatatccgcaataaggggctcctgggcaaattttgctggtgacacaggcacaatgtctttgaggatgatgctacaaggcctgccctctaggacggcacagtgcaaaagaaatagaatgcaacctctgtatgtcattttaaattttctggtggccacattttcttacagtaaaaacaggtgaaattaatgttaataataaattttatttaacccaatatatccaaaatattacttcaacatgtaatcaatataaaaatattgttgagatactttatttctttttttcaaaatgcagtgagtatttaaaatatactgacaatataagtcagttctgaatagcttggggatagtggctacttaattggacagcatggctctggaaggtcaagtcagccttcaccttgacagtctcatctgataagtgggcatatctcaaagttgtcaggtgtctgaaggctccaaatgtgacttgcagagctacatggacaggtgcagaagcaagggatttcataagccagagagtgctcactggaccccacaattccctctcaacaaaaccaggcttatgctgcattctagtgaaactttctctggttggggagaccctgtggcactggtttcgtggctgccctgcagaaatgctctgctctgagcctgggaaatggagctgtttgaaatggatccaggttttcagctgcctggtccctgcaccccatctgccaagcaccaggagcgaggcagatgctagaaacacatctgtcaacctgccctgatggtttctggcacttcccccagcctttctgagactgtgtccccaccctggaagaagccagcactctctgggttttcagttactggtacccactggagggcaaactggggcatccctggatgtggcttcctcagaaagtggtcccccgttctcagggactgatagctctgtctgctttgctgcctcccacccctctaacacagcccctctctgagacaggaagtagggtgtaaacccagcagtccccacagacacagtgagcagctctgggaaggtctgcatgggctgcagtgaagcaaatcccagcatggagcaggccagtgcctgcgtggcaagcgaccaaacctgcttctactcccgctctgcctctctccccgataatatgagttgttttgaggatgagacgagaatatgtaaacaaagttcctgacaatcagtactcaacaacttctgggtagaacaagaccgagagctaacagggaaaagagaggatgccttaaccatggtgatggcagagctagactccaggtcagtgtctgttgtccctcatctgggccattacaggtcaccatcaccgggggttcctgaatgatttcaacattacgtagtttaagagggaaaagtcagtccatctggttgtgtatgtatgggcatattttatatgcctgaaagtcatgagttagaaaagcttagagtgtctgactctcctctgtcatgccagctcccaggtcatagcctggatcaatgtaggtgctcagtagacacggttaatcagacaagagaagaaaggagtgagaaaagcggggagggaagggagaagtcaagaaaatgtgatgaggggtataaggggtaagcaacaaagagacagaccagaaggaagaggtggaagaggtgatccagggtcggagcttcccgctgccccagccctgcctctgcaaatcgagctcagcccacttctcccaaaagcatctccgtggctgggcgcagagggctgggcaccctggcttgagctggaaagccttttgccaactccatttttcctcttaaaccatgaaggagtctaaacgtcagctaaatgagtaccccatatgtggaaatattcattctcacattgatgttttccttataaaagcacgttgttttatgtgtgggtggaggaactcattgtaaactgttaaatatgatgtaaatgctaatttctctgcaatgccctgtaaaggaactccctgggaagtgtgtctagtggaagaccataaaagaaaatggtaaaaataaattagggagaaacgcgggtggtagcatacggtgtctgttttgccaacacgcagccgtgtgtcccccctccaagctctggccctaacaggagaggatttgcataactgcagtgacagatgccaccacttccccacagccacccggccttgacaacttttgggaaacattctgccagggtttgcttccaataaaaacaattcaaaaaatcaccaagcatttctctcttttgcaatttttaataaaattacggtttctagaggtttggatttcaatcctgaaaagaagaggcacaactgacatgatgcaaatctgcctttaaaaccaacctaggtttcaggttgctcacccaggcttgcagtaataaccttttctaaaaacctccgatgcactttggccacattcaaaagagagaacatggcaggtgtctggcgaacacaggcctctttctccatcagtagcctggccagtcttggcactctgttaaccaaacccagctctggattttaaccacaacccaaattttgtcacacacaaaagaattagaattcagggtcacacagctatttgtggaatgaatattagtatattctttacaaatgcatgatgtatgaactgcatatatttctttgataaattgtttttaaatatttcctcctttttattaatcaaagaggaacctcgtgtatcactgccattttttcctgtttttcacataaattattttcttgcaatgttcgtttgtattattattgccgatattaagcaaagactttttttgccttgtaaacaagattttgcttacagctaaatgaaagaagtgaagttaatcacattgaaataataggtttaaaaaggtaattcagtggtgtgggaatgaagtttaatcttcagcaatagaagccgtgctaagagaaatggcagaaaagcttgttctgtaattaaatggtatttatcacaggcaggtcagctctgctgggtgagaggctccaggacttcacagagaagaggaaggcaactagggcaggaaaaaagggcccagagtagagcccgcagattccaagagcgggctgggaggaagagctaggtgcagtgacacctcctggggtccagctgtctaaccttgcacatgtgtatctcagcccacagaaatgagtctggcaaaaatgccaagtgcatcctccacatccttccagaagggacccgatgtacagcttccctagtcagcattaaaccgcacgagcttagaatttacacagacctgggaccaaatcatacagctggtagccccactttcttcatctgtaaaatggagacagtaatgcaccaatctcctggagttgttatgacaacttgcaacacaagacgtaatgtgccatgtaccatgcctggcactgtagcaataatcaatgctaattatagcccactaattaggattcagacctcaggcaaagctagtgcaggttgagaatctctagcccaaagaggaaaaaaactgagcttctcaagcagatgtttctcaggcagccttctgcaaatgtggccaaacttgtcagcaaagcatcaaacctggtataaactgagggcatcagcctgcagctgagaaggctgtgggctgatttcaagatggttctcaaacagccctctgcaaacatgttcaaccctaataacagagcaagtcagtgagttgagccccatcccagatttctctttccagaactctgatttcctctgggagctggaggatatgaaccccagatggcttcgctgggctcagaccatgctgttcatccatgccttccatctgagttcaagccctgaatctgccacttgcaagggtgtggttttagataagtgagcatagaaagtgacagtactgggtggagaggaggatggagttagataattcagggagtctttcatgctgccaaggccaagccctttcctcccacgctacagctctttgctagctgctgcctctttcttagaggcttttggccctttcgctcacacccgagctcattgatgagatcttcacgccactgtgcttcaggaagaccaaaagacccaatgcagggatgtctcactttggggaggaccttcttgtttttaactctggcctgcctgtctatcagggcatttgctggcaggaaattcaagcatccctgatcccccttcaatgaaccccatttcagtagggcctgtttggcattcataggtccctggggctcatatgctgttgacagacaccttaaaatcaacctaatcctcaattggcccatgtgcaaaaacataccagggcattcttcaacatcagggcagctgagcctggcaccactccagctttcatctctaagaagctcgaatttgggtcctttattagctctcccatctttattagtgtcctggagcagagtgtctgcagctaaagttattgaattttcactaaaacctcaatacatgcacgacccttttgtactttcatgttcaaaaaggtacagacttccaaccgccatctcctgcctccatccgtatctttcctcattacaggctgcggtccaaaaccaatacgaattaaataaatagcccactgagagctgcactttggagaattgtctccttgctgtacagatgtgtgctatctccaaacagcaccaacatcttgtattttatcttatatttgaaaaaaaaaaaaattaaaatccaaatagtatccagggaggaaacgtttgcatgggtgaatgtttcatttcattcttctcccagcgtgccctcctctttcatcccataatggctcttctcggctaatctgtcttgaaaacctgcaggtagagatgtttattgatacaaggctgacatgcaactcagtttacagagactattgaaagtgcataaatagtagatttcacttgatgtctacttattaatgcaattccactctgaacatttctacagaaagaggttttgccagatgggagataagtcttatgttatggatattcatgcaagaaaacatttggtttccattctaaatgtctgatacaggctgtccccataattgcatttttcagggcaagtcaccaaattcaacatcaattactttgtcttttagcagtttaagggaaaaaagtttgggttttttgttgttgttaaaaaaaaatcactaaaatctcatagaaacatttcagcccaccatttcatatgaacacaaccaattacttgtgtaattttacaagagcagctttaaccatggttcacacagaatcatcttgtgccctgaaaccacaaatttgacttcccagcagctggtaactttaaatccttaacataatacccacagacatttgttcccttagatccacccaggatccgatgttgctggacagataagcagagtggaggaactcactttaggcagattgtggagaaatatggcaggggagtccatgcactctgcaaggcctttatggtccatccatggaactggaataggaaatcaatggctaagtccagactggggcactgaattcttccacgtaatcattttttccttcctccagtccccggcccctcctctgttgaagacttaacatcgccttgctcatttagagcataattgagactccacttttatttcatcatccttcccctttcattgatcattgctaattttctggctcagtgccatccggggaatgggtttcctaaccccagcagaggtgcaattggagtcatggaaataaaaatgggtttgtactttgtctcatgaaccaagtcagctgatgtgaggagctgaccagggtactcagggatacctcctacccgccacccttctacctctgtgccagcccacccagacttaagaaaatatctccccagcaccctggagcctgcctggcatctcagagcatgtgacctcagcatcttctgccatgtagataaaaacaccagcacaataagggaatgattcctcccccacaggtgcaaaaaagagtggatggccaagtgcagctgtacctccaagtagccagatgtgaaaacagtacatctgtctgcagtttctctgttcaaactgaatcactgattcttcactcatgcctgagaacatgtgccaaggagagatttagaaccacagagtccccacctcccctcctccaggcatatcaggatgggggcagggaaaatttataaggtgcgtatgtcagagctttgaacttaggcaagtgtaaacccagaaaaaagaaggtagcccaccagaaaggagcagaggggaacagtacccaacacactatcccaacataatgtcataccatccctggaggggaaaagaatcagaactgtgagaaatgtgatagaactgtcaaaattatataaaatcagcttcatggattgtgaaccacaagtcacacttctatttgttctataacacagtaaagattgcaacatttccatcaagatatgaaacagaggcaataatagcacagaaaaagacctatcaatgcgatattcaagttatctgtacactcttacccatttctttcatctgatacctaggaagcctgctaccaaagtttgaaaatccaaatcttgcaaagtatttgaagatttggaagctgtagtattgctggagtcagttcatatcagctcccaagagccaactgttaacgttttcaggaaatttgcaagctggttaacatcatgttggtaactcacaaagtcggccattattagagtatttacaccaaagaaataggcacatgctatgaggacttttcttttttcagagagctggttgttaaccatttactaacatcattggttagagggctctcctgagattggtcagcatgataattagatttagatttagctccatcaagttctctttcaatgctctcgaactgcttaagcccatggttttctaactgccaacagcaagtatcttgcactcccagaagtgcctaaggataaatggggaaagaggacaaggtgaagaatgagtcttatacacacccctgacttaatagaccatcttggctttgagctgttagagtaggtctcactacaagttcccttttgtcaaagggctctgctgctctaaaagcttagtttaactgagattgcttctgtctgtttaactgagatgtctgtctgtttgagtcttcagagaggggagatttatgcaaggccacacagtgagggcaaggctgtgggagaaggactcggcatcctggacccagcttcccctggactcgttacatgaccttagacaagcccacttttccttttctctggtgtataggtggacttggtgatctctctgggcactgttggctgtgaaattctgacattcaactctgagttcttggtctaaatagactctcgagggagtgtggataatttaagaaactgaaagacaagagagacagaccaatgctatctgatttttaaggagaaaacatggagcgatcatcttgacccagactcctgaagtccccagacctgcttactttctagatgattcacaagcccttgggaaaggaacatcaggaatctacttggattctgcaggaacaacccagccaggccatgagttgggacatctgagtcatacagacctagatccaagtcccagctcctccacctacatgctaagtggcaatgggaaatttacttaacctttctgatcttttgattcctcctctgtaaaatggatcataataacacccactatctaagacttttgctaagaattaaatgaggtaagccacggaaagtacttagcatcacattagtccagactaaacactcaataaagagcagctactaacatcattatttcctcaggtgatggggctaaatttagaggccagggaaatgaaacagacttggaatttgcactctcagctttgacctgcgttgaatccatgtatgggactgagctgggcctgggcttctaagacagattgctgagtggactgtgctcagagggaaatttttggggtagattagccaggaggcgattttgcacaagtcagtttgggttggaatcagttaagtttctttttatttggagtgaaaagagcaaaaacatacactcgagaagccacgatggactattcatatcctgggcctgggccaggaactcatgcccaggtcctctagggagaggcctcaggaagagactagtgaggctgagctctcaacagacttgctgagacccagtgcatcagcagcccttgtgacaaagtgtgaccccaagagaggaagcctggacttctcacttctgcaccagacccaaagcagctttaatcaatggggatgccaagaatggtaccaaagtctgggatattgcacaccacacagtgggcatttgctttcttgcagggagcaccagcagaggtggaagtagtgaggttccctgccgtgatctttgggccgcaggggtcagcaagaaaagaggagcaggagagaaagaatttagcaagtgctgctgtgtggggaatgagatttattcctaaccatataaggggctccacaacaaaattgggagaacttttcataggtccataaatggggctagaacaagtaaaacttggatgatttttgttaatgtgaccctgagtttaaccccaacctggggttccacattttggatccagaatgaagcatgcatccattcagcagaaatgctttcaagatatccttgtagacaggtgggaaaatgtaagcttcgaggtgggtccatgactcgctgaatgtacctaaaaggagagtcttatcttggtgcaaaattagaatcacctggagaactttattttttaactagagacagggtctccctctgtcacccaggctgaagtgcattggcaagatcctggcttactgcagcttctaactcctgccatccctccaagaagtgcaaggtcttaaccagatcctctgactcttaggctgggcctcctgactccacagccccatggctgtctttcctgagttataggatgctctagactgggtatcttgggtagaaaatgaaccacaggactttgaatattgcttccatctctgaatgcctatgctgcctcagaggctgaggctgccccagtgacccacctgtccccaggcctggctcccaccaaggcatgcccacttcctgaggccttctctcaggaaggaaatcccagtcatcataaaaggaaaataaggaaataaaatcttaatgggatttcataggtgatataaaatctctacaactctgggtgacagacactaaaaaagattatttagagagaaaaagctttctaagacttcctgtggaattggttatctgaataagcttgcatggtagtcatatataatgtcagtggagggagggccagaagggtctgggctgactggggcctgagatccagggagactagtttgacccactgaagaggcgctcagagtcatgaggcaacaccaagacatacagtcctgtctgccttatgaccttcgccacatccttcaggccttgactcagccactgcctcttctggaaccttccctgaccccccaatagattatgaccctccacttcttccccagtattcctgggacatggttctattatatagcagtgtttttcagaatgtgtccacagaacatcagcattggtattgactgtgtgtatcttgttagaaacaggctcctgaaacccacacctagacctgccatttcagaatctctaggggtggagcccaggcatctgtatctccaacaagcttcatgggtgtaggtgacattttgttgagatctgggggcaagaaggagctcatcctgtgaagatctgggagcagacagagaatggcaagtgcaagggtcctgaagtgaaaaagcatttggaaagtctgagggacagccaagaagatagtgtggctcaagagacatgtgtgaggggcaaaagtgggaggagttgaggttgttgatatatcaggagccagattctggggggaagagtttagaccttattctaagtttaatagaaagccacaaaggcgtctgttgaagactgaattattggttgcaattcttttttttagaaatggggtatcactggagtgcagtgatgtgatcatagctcactcactgtgacctcaaactcctaggtacaagtgatcctcccaccttaaccttcctccccttgtagctaggactacagatgtgcaccaccacacctggctaattggtttttttgttgttggtttttgtttgtttgtttgtttgttttttagaaacaaaaatcttgctatgttgcccaggctggtctcaaactcctggctgcaagttattctccctccttggcctcccaaagtgctgggattacagagatgagccaccatgcccagcctggtcccaattctttatcccactattataaattatctctccacacatttgctatggcctcatggtgatgaagtgtacttcctttctctatgactttgatcttggccgcatgacttgctttgaggaaagggatggtggtggatgtgttgggagctgaggctcggaatgttcttgcacaaatgggctttccttctaatgttcctcttttttcaccaggagtagagaatgccttaggtagccattgatccaacaaggatgggaaacatatagcgttaagctggacccaacctgcaggccagagccaaaccctacctagatcagctgaacctcagccaaccctcagacacatgaacaggaaataaatgcttgctgctatacatcactgagttttggggtgactggttatatggaattacttgaaaataactgtgtgataaaagctttcaacaaaggagtgatttgatagcctttttgtaaagaccactctggcagtggtgaggagactggattgtgaaagactcatggaaatgagaaaatgagcttgaagcccattgcagttgtctgggttggatcccacagtgggttcgactgtggaggtagtggtggagatgaagagaagcgaatggattctagatgtatgtgggagataagagctgacaggatttgctgataggctgagtttggggatgtgaccacaacattatgcaatttcagaaggaagcacacacaggaagtggtgcaatttggcaccactggatacagtgaggagagaaatggagatggatgaatgtcttctagatttttggcttctgcgactgggaggatggggggtcatttaccaagagaggaagacctgggaggaagaaaattgatgagtgtgggtggcgggaggcggggaccaggaggaccaatatctctgttttggccatgctaagtttgaagtgtccattgaatctaaatggagatgtcaagtaggcagttcgatatatgcgtccagagctcagtggagcaatcagggctggagttataaatgaatgaaccaacatttgacagtggtgtagcatgcctttgctcaggctgttccctttgccacatcttccctggccacttagctcctatttctgctttaagacccagttcaaacatcacctccatgcagagtttgtggttctcacctctgtgttcccagagttcactgtaaatatctcacatgttccaaatagcctgcctcccccactagaccacaaactctgagaatctttgtattcccagcacctaactgaatgcttggcacatggaagatgctcaataacatcaacttccttccttcaaggcattgggctgggtacttataaaagcaatgctccatttaaacttctccacagtgcagagggtatgttgtcattccatttcaaagttaatcacactgaggccctgagggattaaggtcctgcccaaagtttctgcaagtggaagcatctggatctgtctgatttcactgcctgggctctttccacgttgcctctgccccactcctgcctcccatcccctccctcctcccactcccttgcagccctcctcctccctggcagggctcccacgctgcctgcgcctccacacaggatgtgcttcctgaagttcctggtccagatggcccacggaagctgctcctcataaatcaccaggcctcgcagagctgtgctcagccactttctcctctcaatctccccaggtcccagtgcgtgggccccatctgcccagtcagcagaactggcttctctagactggggagcagatctatggtccccctccccagcagggccaggagccatggagcagattcctgagagctgatgaggggactcacagagcatctttgttagggactaggaggtgactaaataagatgcacagtgcttaaaactttgcccccagtggaggtgcaggtgcaaagggttaagaaatccacctgccagccaggccctatcaccactgggtattcggacccctttgctccctaagacaccatgccacagggcaattgcatgcttggcaccaccaagtccccaaatacatttcccaatacagatcagcagcttcagtgacaacccgctcgaggcccagcacaccttggacaagtcacttcccttccctgaactttcattttttttatttgtaaattgcagataatagtatctgcctctcagctatgctaagaagtcaacagacagtgtttcaaaaaggcacatggtgagtccccagaacatggtaggaatataaatgcaaggcacccttgagtattgccctactcaaaaatgggccagaagtggggacaacagggacctgactccctttttttttattccattaccaccatctccttaatgtttccaaagcacagactgatctgatgtgtccctcctctgcctaaaaatcattcagtggtcctgatgtcaccttaggcagtaattctccatatcttcttttctgtaactttaaaaactacagtttgggaccatatacttggaggctgtggcaaagttggctagctgcccaccaaaaatgcatgctcctgttccatggtacgaggttgtcagatcatggttgcccaatcggaatgacactttctagcctctcttgcactagacggaaccacatgactacttcttatcactgaaacatgagtgaaaggtatatgcctctcccttccaagcagaggtgcctttgccccaccttctctttccttgtctgctagctggaagaaaggattctaagttgcaagaacttggtggagccataaaacgaaaggtgcctcaatccatgaatggccctgtggaacagagagccagcactgtcaattgagtactcactttctgcacttgaaggaaaattttttgaggccaataatattttacactttatctgtgacagcagctagcattaccctaactcaaaggagttaaaagattcaaaatagcataaaacaaatcaataataatgatggtgcaatcatgactatagtataacagtacctcacagaatctataaaggcacatacctgtgctgactatttaacagagacctatgggtaccacatatcaatttgagtagacttagtgccctggtcttgctccctatatgcccataaaatgccacccttgactgttctactaagcatgcctctttgcatcttgtcacacaacccacccacccactggtagcatcagcctgatttccatctgggcagtcacgctacccctattcttagtctctaggttccaataggtctggcacattgtctaagcctggccaatcaaagttctactcacgatagcagtggctggcctaggagtgggcacataccctacagccagttgaatcatcaattatggtaaatagcaagactttgtccaggtatgctgggggaaacacaattactcttttctgctatattcaaccctagaaaaaataataacaaccatgttgcaaacacaaggggagagcctaagggagaatggtgccaaaatggcaggagacaagacctaaagagagagagagagaaatcaatccccaattacatcaaaccatggtcttttcacttccagaaatcaatacattctcttttttcctagctccaacttgaaatggattttctgacccttacaatcaaaataatcctaagtagaactcaggtgtgccagcatttgacagcccaaccctgaaggattggaagttccccaacaggagagcctctggcctacatggtacaatttaggctgagtcctgcacccacaactcccttaccagcccctgcatcctctccccttcctccatttgcctgtcccccatatcctcttcccaatctccacacaaatgatgttgaattcccagaaagtagagatccttctcctaccccctgtctctgctatttgtttccttacccaccacctttgctcaactacccataaccacttctcagcctccctcaaaccttacctcttctgtgaattcatctctgaacagaaatttgttttcaattaatcaaattctttttctctcttttttgttcaaatctatgttggttctctaccaaaacagatctgatctttaaaaaaaatgcccaaagagacattggccaagtttcagcatgaggtatcactgaaaccacttcaggaaggataacaccaccacagacttcctgggaagaagagatgtaaacccacctcagaagatgacagcagtgaagaaaatgagcatcacaaactggttcccaaggcctgggcctgagaaacactcaggagagccaattgctgaaaaaataataataataatacccagagagaggaagccttttcttcaggaggaaactgactcacactctctgccctcagatcttcctgttctcacccttacacctccactccaactacagtgcctccttgctgtttctcaagcaaccaggcatgttctcacctcaacacctgtattggttatttattgctatgtaacatacaactcgaaatagtagctgcttaaaacaagaaactcttttttaaaaaacagtctcagagttcctgtgggtcaggaacctgggagtggcatagctaggttattctggtcccaggtttctcctaagattatgcccaaaatgtcaatgcagttatacccattagaaggctgggggctctgcttccaaggtggcccactcacaagcctcagaagttattgctggctgttgtcaggaggcttcagttccttcccatgtggacttctccataggactgactgcttgagtgccctcacaaggcagcagctggctttccacaggatgggtgatccaagagagagaaaggctgaagctgtcatctcttttatgacccagccatggaacccatatttccacaatatcctattgggtacacgttagccctattcagtcaggaggggactacacaagaacatgaatactggagtcattggaggccctctttgaggcttaggaccagtgagactttacacttatcacttccgctaccatcctttccccagatatccccatggcttcttctttttcctccttcgaatctttgctcaaatgtcactttttcaaaaagaccagccttttaaaaactacagctcctcctcttgccccagagcattcccaaatttcctttcccaatttattttattcattgcatttatcatcaaatacacacacacacacacataattttgtgtttttgagttttagatttacagaaaagcaacaaagatagtacagagactcccgtatatgtttcacctggtttctcctaatgtttgttctggttgagtttttttgttattgttgttttgttgtttttttctgtcttcctccattagaatataagcgcaatgaaagcagtgacttttgcctattttattggctgatgtatcctcagtgcccaaaacattgcctcactcacagtaaacattcaataaatatttgttggatgaatgaaagactatattaccagctcaaagaaaagctgacacttgccttttgaccttgaagttcttaacagaaacacacaggatatttaacataggatgacccaggggatttaggtagagtatttaaaactcagcagggaaaggtttgggtgagaaagtgtacacctaacttgtcgtaaaacaataaacttcatttattaattttcatttttctctctttgctcttttcagtatgatttgctttactgttgataaagtgagttggctttatattgtgtcaataagcccatcttcatttatcaataacacgaatgcagtatttccctagaagaggcttaactgggctaagcagcgatgagaaaggagagaggatgacttctgaaaaatccaaaagaatcacagactctgagatttccccaatctagtggagttttcctcagttccctgctgagccttcccttgtagggcttcccatctggaaggctcctcctctctctctttattcgctgggaaaattatcccaacaaagcaatcacaggatgcatgtcttgtttcctttgctggggtcacctccaccagggcttaatagccttggtgaattctcactgatggattgatgttggcccctggactctgagcccctccaggccctgcaagccccattcctatgtcagatccctgacagctcctaacccatccaatgctggggcaattggctgggggtgaggcagtgaatacttatcaagcacctgcaataagcccagcactgtgatatgtactctacagatatttaactccactgagactcagcatcacagttaaaaacaaggggaggtgggtggccttgagtgaggcttccagagttcaaaaataatagttcctacttgaggactaccatagagatcaaaagagaggaggcaaagggtttaccattatgcctggaacttaaaaaatactccatcgtgttattttcaaacaagggcattttacagatgcaaaaagtggagctcagaaaggtgaataaatatgactgataaaatttaggtccaggtctgcctaggtctaagtccttgcagtacccactatattagtgtcactcgaagaatggcatggagatatttgcattagaatcacatgaggagctggtttaagaagcagaatcccagacgtccagaactggaacccctggagggtaaggcccagggatctgcatctttcaccagctccccatgtgacctaatgtgcacgaggccagctcacctctcttggacctgacacaagccagggatttgtgctttggcccctctgttagttcaaatgcaaggcatgggcagcattctctgcagctttctggggcccagctaaggccattatgaccctggactcatgcatagcctgaaaggcgagtaaagctgtgttcctttggatcagggcatcactgagggcagaaaaatgggtctcgggtctcaaggaaaacaagcctcagctgggagaagaggatgaatcaaaaagagaaaaccccacctaattctcagcacagggcagcttgctgaacagaaatgtctcattgtgccccactgtgaagcagtggacctccatgccacataaagtattttggtacctctctcaaggtactgtagaacttgaaagagacttctttgaagcttctgtcagatgacaggcagagctgagtgtaacacatacccatcaaacagaagggactcgggttggacctggaagagcatttggggaacctttcaggggctccaaggctggcaggccaggaaggggctacccaccttccccacagtggtggttcacacagccccgcccagacctcagctcttgctctgaaccaagaactatccagggcatttcacatatgagacctcaggtaactcacatcaactctgtggaacatcactatgcccaactgacaggttgagactttaaggcttagggagatgaggtcacttgttcagagtcacacagcagagattatggagctgggattcaagttcagtcttaaatggcatctgccctacacagagggctacaagcaacggactggcagggaggggaagaaggcttggccatgtgcccctaaggctcaccattcaggttcagctcttggctcctgatgctctctggagtcccccaactgggccagtctcccaggcaccttgactcacccctctcagcacttgactgagcaaggtcctttcatattttaataacgtgagcaggaagtacagagagtttccatgtatctcccacccccttaataagcccaacgtctactactgacatcctacagcacagtgatacatttgctacaattgatgaacctatattgacacgtcattgccaccgagtctgtagtttacatgagggttctcttttggtgttgcatatactgtgaatttggaaaagtgatgtgtatccacaatcatagtatcagagagagtactttcactgccctaaagctcctctgtgctctgcctgttcatctcttcctcccctaacccctggcaaccactcatctttttactgtctccattgttttcccctttccagaatgtcacagagttggaatcacattgtttgttgccttttccagttgacttatttcacttagtaatatgcatttaagattcctccatgtctcaatggctccatagctcatttctttttatgactgtataatattccattgtctggttgtaccatagtctatttatccattcacctactgaaggttgcttccaagttttgctaattatgaataaagctgcttttcatatttttttaaaactttattattattgtcattgtagttcttgatatcgttaatgcaagtttacaattcagattaaataagaagaaaagttcttaatctctgctactccaaggattgctttatcttatatttttttaaaaatgagattatacgataaatgttattttctaattatttattttccacttaatctgatgtggaatatgtcacctgtctcaaagacatggtccaacttgtaacatgtttgtggggttctggagatggctgtgtgacttattcaaccagatcctttctgatggaagtgcagattgttccagatgacttacacttgcaggttctcatggtgaggaaagttcccacactttttcaacccagctacgcgggactcacataggccagcctagcccccacttccttcccttctcacatgaagacttgggaaatgttaagggaagaagagggggtctcaggagccgaggggctggcaatgcggatgctgctgatgtcaagtaaaaggaagactgaacaacacccatcagatttagtggcccagagttattcttccatgccctcacctgacctcggggtgaggcatggaattccagcctcctgggggaggggcagcaatgggaaagcccaagggtcatcagaattgctacctatctggcatatgtatccttgccctgatgcctcacacccattctcagttccccaaaaacagccctaccggtagtttctgttcttcccattttatatacaaggaaattgaggctgagaaacctcacctgaagtcaagtggccaataaatcacaaagccagggttcaaactcagttgctcagggcccaaagctgggtcaattgccccaaccagagagatggcccagccagcccaccccatgggctaaatgacctgactgttgtctgagaattagctgattcccattcaccagagttctcaaaaccaccagcagtttctgcattggttattttgctgcttttttcttttaattaaaaaataatacagggctacggtttaaaaaacatttaaactggagagaaaagaagcaaccctcagacccattctctagaggtaacttatgtgaccaattttgggggccatgatgtgcatttcatacgtattttgtgtgcacgtgtgtatgcacacacatgtacacacatacaataactgcactgcacaccccctattatagccagcctctatgcactggatgctttcaagaacattgccccatttcatcttcatcagtatgccagggcctggacactattaccttccccactttagtgatgagaaaattcaggttctgagaggctgagccacttgctcaagctcactcagctagtgagaggcgagactggaattcaggagcaggcttttcatagcaccttcctgcctataaagaggggtggctgagaaaacccattccatgtccttgaaacaaaaggctcaggaggcccagactgggggatgaagtaatccctcaacatctagcaactatggggcacctactgagtgtcaggcagtacattgcctggacctcggggatctcatagtaacagccccaagaaagaccatcctgagcaagaggcacccctggcctccccatggcccagaaggatggcttgcatggtgacaacagaggcagcaagaggggagggaaatgggtggcagctccagtggacacaagcaggagtctgcagagcttcctgggaggggtcccagggataagacccacacagtggtcccgctttcagtcatttcttccttccaagctctcacaaaagtactcgtggcagatctatctgggtcacaggacagaaataaacatcatttgaataatcccaggctgacagccttggagaatggacaggaaaattagcccctggaaaaggcaaatctgagcatgtcaccagaggcaccagagggtgtctcagtagcctcggtgcctcctgggagcgctcaccctcacccaggcccttggctcaatgcccgagagaaggagacagcaaaatgcagactcaggagtggaggcccacgacatcagccagtggcttcattgttgctatcaaagaagacaggattcgaacccaggtctctccaacctcacctcttcctcctgtctccttacaggagccatctggagttgggtggcccatctcagaaggagttggatgtctcgcttggagtctccatgacaatcaatgactcccatccccagtggcaggatggcttacctgagccagccacacattgggcgacccctcacttggctggcatcaaaggtgaggttgctttccaggtagaagggcacagccagtggcaacgaatgcagaaaccaccattggtttcaagaattctagatggtggctgtcagctgattctcaaaaaacaatcaggtcttttagcccacagtgggggctggctggactacccactatggtgccacaaaaagggcagactctggaccagacatctgaattggagctctagctctgtctattcctgtgtctacctgggaagatgatcagatatctctgagcctcagttttctcatccgtaaaatgggtaagagtaatctctgcctcgtgggctgccaggagggtcagaggacatggacctaaatggaatgaccacaataggaacagaccccaaaacctgtcaagctgagccagggggtctctacccttcctagcttctctccctgtttcccaagctggctgggctcgaggttgtgctggccgagcggaccaggcacaggcatttttccctcttgctgagcaatgcggattgcgccaagcgttccctctccttttgtgcatgtttttcatgacccgctgccaacagctctttgctgggcggctgccaccatttacccagcacaagaaaactgcctttcttcccccatttagggtctggttttaatttctacagtattctctttaataacaatgcctaattaaaacatctgttaaaaagtctgtaacattaactttacagggagaatttaatagaattatattggaattgcaggcatttaacggccttcctaattaggcttttctttaaaaaaaaaaaaaaaggaaaaagaaagaaagaaacattctacaaattaaaatctcgctcttttttatgataatgtaggctgatggtccagtggctggagaggacaagtggaagcagatagagagacgggagtcatgctaagccagtataatgacctttgtaggatggagaaggaaattggagagaccctgcatttaatgacaggcattgtaccaagagcactctcatttgtaatctcaattacttcctgacaacagtcatagaaagtagtattcaccccacttgaatgatgaagaaactgaggcagagagagaagtaatttactcaaaatcacacatgcacacagctagaaagtggcagaaacttcaaagtatgtactcattccactgctccccacagccttccagctttgcatccaaagagttttctagagccctcagtggggtctttgtctccgatttgctcactgcttggtggtgagcatcatggctgcctcccataatcatctgtagcttgtccccggtttctttctacaaattcctcgtcagcttgatgctcctacctgatcctccctggccctggctgtcaccctacacgccaccggcagcaagctggagcatgtggtggagtaggaatacagcctagtgcctgctggggcacaccccacaagggaggagtcaacagaaaaatgtccaaagtgatcatcctcaaagtctggtccccaggccagccgcatcagcatcacctaggagcctattagaatgcaagttctcaggccccatccagatttactgaatgagaatctccgaagctggggccttgcaatctctggttttctgtttgtttttgttttgttttgttttgttttgttttgttgttttgtttgagacagagtctcactctgtcgcccaggctggagtgagtgcagtggcacgatcttggctcactgcaaccctcgccacctgggttaaagcgattctcctgccacagcctcctgagtagctgggattacaggcacccaccaccacaccccaccaatttttgtatttttagtagaaacagggtttcaccatgttggccaggctggtctcaaactcctgacctcaggtgatccgcctgcctcagcctcccgaaatgttgggattacaggcgtgagccactgcgcccagccacagtctctgttttaataagctttccaggtgactctgatgccattaaagtttgagaaccactgatctgaagataaaggggaacttttttgtcccttaaccctcccaagctagacttcagagtctagaggtttggcactttacctttgtaatgtgcctttgtaggatggagaaggaaattggagagaccctgcatttaatgacagaggtttggcactttacctgccctgagaggcagccttgccctaagccattgaccctggcccagtccctgccaactatcacagaggtaaactccaagcagagctcccgacttgaggctggcctgctagttacaggaaacaggtgggattaccatctttaggtagtaggaaagaccaaacccaaatgctttcctgccgcttcctgaaaagagccccctgttcccttttagccaaatctgacctcaacagtgctccccagagtggggtatgggaggtgaagccagcctaggctactcaagaaggggctgagtcacccaggaaggatttaagcagaaactcccaagctcaaggaaaggacttttttccagccatggttttaagattccagcatggccctgtctgtttttaactgacctaccaagccctggggtggatttaaagataattcagcagagtaggggcagcagacagacagttcccacagcaggttagtgaggccctcacagatgatgtctttgggtccgtccccagcggttgtgtgagtggcttgtttctgtcctgatgaagcaggaagttgggtgcaatgaatagagcaaggatttgagaatcagacagaactgagtttgaagcttgaccctcccatacattggccacctgactttgggtaaatggcatttccttgctgagcctcagttttctcatctgtaaatgttcaaggcacagagctggtgtcctgattcatctggttttaaatctacaaagaaatcagaagcaatggagacagagatggcttaccatcctttgtcctcactcaggggtccagcatgtctgctggaggtttggaacaaacagttatcacacagatcagggaatatggccttttctgctaaaacaaaacccgaactttgtggttggggtctgggcgcagagcctctgggtgaggagtggctcctagaccacccaaccctaactctgtcccctaagtctctcctcctccttaaggatttcacttggattcctgctcccaccatcaagcaggtttccaagctctgttacccgtctcctttgtcaccacagcctagggattgccagttcccttcattcagctcctctgacatacttaggaattcttataagccttccctaaacatcaaggaaggaaaccacaagaggaaaagaaaacaagaagaggaaccctggagtaaaattgccctgctatttattggctgtgtgacctcgagcaatttaattaacctctctgagcctcagtttcctcatccatcaaatgggaacaatcacaagatgactaactgtggcattgctgtgaggattaaagaaactaatatttgcaatgcacttggaagagtggccagtacatggtaagtgctacagaagtatttgttctataaataataaatgaaggcatgaatccagtcacgctcccaactctgaaatatcaaaactttcaggttcccaaggcttgaaattgccaccccagcccatccctatcctaggccctaaaatctggtactgcacagctgtccctggctggaggcacttcccatcacccttccatgtatagctgatctctcacatgggccagggcaaaatccccaggggagggaagcaggcaccttccacctgggccccatgtgactgctttgggaggactggaattcacagttcagtgcttgggcagattcaataggacagcctcctgtgtgatggcttcttctgttcaattactactaaaattcaccaaatggaactgagaggttttaacggcagtaattgtggtgcaaaatgctctgtaattggtctcacaaatgaaagtgaggagaatgctattgaaaacgaagctgccttgccctgaacagttcaagagtgatggcttagacatgctccccagaaacctgttggtcccaccctctcatgcctgagacccccgccctttggcctctcctggtgggaacctcaggcttctctctctctgtctgtgctgaggtacagtgatgggggacagtgctggcacgcccctgcagaccctctccaccctggtcatccctggaacctcaggcctgcagacaccaggaagcctgaaaggcctccttgagtggcctttttattccctgctgtcttacatgcgtataatctcaggcccccaggcctttgctctggccagtccctcttcctggattccgttcccctcactttccacacatagtcacttctcatttaacctacgcagtggagccatcctctccttccccagacagaagtagcaatgcctgccttctattatagtcccttctatatagcccagacactactatgaataatactgataacagttactctagtgaaggaggagaactgtagttcaacagctggtagcagaattcctctgcggcactgtgtctgccaacaattccatccctgcacacacctgctgcacctcccatcaagaaagcatgtctgttttccctccccttgactctgggttgctcctcagacactgttttgatcaacatgatgaggtgaaagttgcagtgttcccactccaggttagcctttcagaagcccagcagctttggcttttgctccctggtaagccagatgctgtactgcaaagaacttggactggatgcctggacgatgggagacctcgtggagagagggcatggagaatgaggggccatctctgacattccattcccatttaggtgctttgttttgcagcacaagctaactgatacattccactaaggagaaaccttttctttttttagcataacactctgatgaattatttagtttttttttttaagttctggagtacatgtgcagtatgtgcagatttgttacataggtaaacacatgccatggtggtttgctgcaactatcaatccatcactatttaggttattttaaataaaaggggccaggcgccatggcccaagcctgtaatcccagcactttgggatgccgaggtgggtggatcacctgaagtcaagagttcgagaccagcctggtcaatatgacgaaaccccatctccactaaaaatacaaaaattagctggacatggtggcacgcacctgtagtctcagctacttgggaggctgaggcaggagaatcatttgaacctgggaggcagagattgcaatgagccgagattgtgccagtgtactctagcctgggcgacagagcaagactccatcttaaataaatacataaataaataaataggaagggggacatagctaggatgtgcttgatattcacatcagtcacctgagatgttcgtgagaaataaagtgtcacagattcactcccagagagtctgattctgcaaggtggggtccagtaatctgcatgtttgacaaacagtgctgatgactgtcatggacacagaagtttgagaaccactgtctgggaaagaaaggaagagctgcatgggtatttttagatgtttggagaaggagaatgagatggccaagctgagaattccctgggctgggaaggccttagacctcctgagagcatggtgctaccaactgagctgggctggccccattgtgtgacccgccacactgcacctgggtctctattaaaagtcctcccaaacttgggaggtgatagatgtattcattatttgattgtggtgacagtttcacaagcgaatatctgtcaaaatttttcaaagtatacacttcaaatatgtgcaatttgttctaagttcattaatttcaataaacctttttttaagaactgttgcaaacacaactgcccttcatgaggggggctttgatagggtcacctaactggaacacttcagaaagtgagaggggagataatacaatgggacaacatgcataagccatgaccatccctggcatatctggacatttgatcaccctctgctttggggacatcagggattggccaggacaaagggaagaggaataaaggtgagaaatcagaaaaatcaggaaacaggagctagaggtgactaagagaagcaaggattgtaagaaacctgttgccagcactcactaactatgagttctcagtgcctatactagctcaggcaaacctcacaacagccccattttacaggtaggcaaacaaaggctcaggagagtgacctgcctaaggtcacccagcagtaaaaagcaaacactggatttgaactcaggaacactggctctaggaactgtgaacctcaccccttctgggactactgccatatgtgagtgagagactcagtccttcttaaagatcagtagaaatccataaggccagagggctgcagaaaccacacacagctacaacctctggtcacattcacattgactggctgtttcctggggttcccagcttctgctttcaggacagtgtcttatgtaattctcacaatgactgcagggcatacatttttattatcctcctcattttacagactaggaaatcgagacccagagaagtttgccccgaatcatccagctggtaagtagtgaagccaggttgaaactaggaccagaactagacaccaagacctgaagtttactgtcatttgaattacccagggatcttatttaaatgcagattctcatttagtaagtctgccacaaggcctgagattctacatttctgacatttttggttgttgttgttgttgttgtcgttgtgtttatattaaccaagacctcctggaaggccaggatttgtcttactcgtgtggcacagttcccctgtgttgcatgtgttagaaggaaggcctgggacccaggagcttcttgatgataataatttgatgcgaaggaaggaaggagcaaagcaagataagaaattggaggctgccccttcttgcacacctacctaacaccacagcttgtgctcagagagcacacgaaagaaaaagaatcacatttccagtattttcccaccactgttgcagctcagggcaggagcctcaaagaggcgagggaagtgaccaggggacacacagccagggcagtgatcggtgccaagtgttgctctctctgctccatggaggaagcccaggcactgattctcacccctccctgcgtcctgggccaagctgggagcccaggaaaggacattccaggaggaaatgcgtggttttcactccagtgcccctccatggaccacagcccttcccttccctcactctcaggtcctgacttctctccacgtggggcgacccaggtggtctgtggccagggaggctgagtaggcagcagggcccatgagaggtgggggctgtgtcaccacaggctgagaacacacacactcgctttcccataagaatccagcccagccactgcccaacccacccgccaggaccaccacaacaccaactttctcaggaaacctggatggggctgaggactcaggaactgacatgaggcaattggaggcctccgaggggggagagaggaaccacagttggtgttttgtggacggagtatgaggcgtttgctgatctcagcagaccaagtgcctcctgtccctgcagagaacccgaggggaggaactgacagcagggggaaaagtctgatgaccaaagtcaggacagagacgaagcagagagcccatagacaggaatagacatagaagggcagagacattggggccaagcgagactccacgaaaaggagaggtctggatggacagttacaggcacaagaggaagggaagatgggggcagagggatttatcaggatgggcattccagtcctggacaacactaccccctcttgcttgggcagaaattctggcttccacaccccagggtaattaataccttcttatgactcaagccaaactggcaaaaggctggcagatgaacggtatgtcaatgaagtgataatgttggtagagcctgggacacagtccccatcccctacaaagccctcaaagcaagtgagctggggctctcacgatggttcattgttttgtctttagggagtggcaggtgcctaccacccagggaatgatgagatgcggggaaacccagcccaaactggagcaggccaaagggagcccatctaaagggaatggaatagtccagtggtccctggaacttaaaatgggtccttccctcctccctccaggacccccaaccagtcccttctttctccaagaccgctgtcttattcttgtcacccaagcccgggaatctggcagccactctctggccagagatggaactgggaggcatttcctcaggaaatgaggcctcatggaaaagagtgcacaccacagaggatttgctttgaggagtccagaggctcttcctctgccacttaaaacacaaaggagaatcgcttgaacctgggaggcagaggttgcagtgagctgagatcacaccactgcactccagcctggcaacagagcgagacaccatctcagaaaaaaaaaaaacttcataatcaaaagcactctgaacccttccccagatgtcagcccagatcaactcttcattatcaagtacgcagaagaattctcgattaagcctaagctcttcttatttggctccatgatgccccaattatcacagcttggtacctgcacagggagctttgtgctggttctgaaaggcagagtggcctctctgagggtctcagcacaggtcacaggctcagtaccagccactgacccagcagagaatccagggaaaacaggccccaaggagcatggtcctcctcacatctcctttggctgggacctgcctggcgctgcctccccaaagccatccattatggggtaaggcttgtcattcacttcccaatgagctgcccacctggccagagtcaggtgaaagccaaagatgcagggaggagatttggaatggttaagtgcccttcaccactaacaaagacatcagggtctatatctatatactctctttgtttcatcatcaacatcaccaccagcccaccatcaccaccaccatcttcattatttcctaaacactatgcaccaggcactgtgttcagcattttacatgaattaactcaagtcttttcatcctcacaactaccctataaattagagaccatcattatccctattgcacagatgagaaattgaggcacagagaggttaagtcactcatctacagtcatacagtagtagtggaaccagggtttaaacctaggcaatgtgactccagagctcacctattctaccacatgaccgtaatgacacactactccctcatgtgcacacagccctccacagtttacccccaaattcctcatccatgactctgtgatttaaatagggggtgcatttctcttcaaagaagagcaaattgacttgcagggacagggaccaatgggcactagaactgggactcttaatgctcacctgtagatcccaaagtcagagctcatgcctcagccttgctgccccatatcctgggatgagataaggccttttgttgagtccaggaagatcctcagtctttcaggatgcagttggcagccatggaacccagccctgccctgatctcttaagacacctgggccaagccaccacccaaccaggcctgcaattattcacctgcccaactggcacccagcacactgcatccttcgtctcctggggtaggtttctacttggttcagcatgcagcagattagagacagggctgggagaatgctggtccttaggcttcctctccctgtccgcagtgtctgaggagtttgcagcactggtgggagggggctgcagaggtgaggccaacctcactgagctcccaactgaggacctcgtttgtaacatagcaaagaacccaaatataactgagggagggggtgcagtggcttcaatgtggcctagatccagggtccagcaacgtggaagaagacaggaaaacagggcagtgggactggaggatgaagccaggggagtcagaacctgcaatggaatgagagtggaacaggcttctgaatcagggacagctttggcccaagagccccctacctctcactgcctactgctaacagcagcagcagcaggaacatttgaggaggcctagcccccaccacaggcctgccaggaagcatatagtctggggaaaacaacaggaggaaggtggacaccaggatcccctatggtgaaaactgaacccattgcagacctccaccaaggtacccatatttcaaaagagtttatctaacaacaccctaaatattttaagtaatcattcattcatttccatttgtgaatattcataatcatccagagttttctggccagtagggtgaccccaccacgctggtataatttccccttcaagcaaagctccgtgctttaggtaacttgggtggcctgatggcgacttgctgaaatactaaatatagtttgagaacaattcctggccagtctgtaaccagatctgccttgttcagggctatttccccagggaacctggcacatgaaggttctcaataaacaaatatttgtagaatgaatgaatgatccctgtattagtacgttttcacactgctattaaaaaaaaaaaagcctcagactgggtaatttagaaaggaaagaggtttaatggactcatagtccctcatggctgaggaggcctcaggaaacttacaatcacggcagaaggggaagcagaaatcttcttcactaggtgacaggggagagaacaaaggaggaaccatcagacacttatcaaacaaccagatctcgtgagaactcactatcacaagaacatcttgggggaaaccacctccacgatccaatcacctaccaccaagtccctccctcaacacatggggattacaatttgagatgagatttgggtggggacacaaagcaaaaccatatcagcctccatgaagggaaactcccaattctttacttcttccaacatgagctattccctacacccaaggggatccctaccctcacccagaagttctcagcagaatctgtctgaatttgcagtgtgttaactctgccatggccacagagaggcccacgggcacatacacacatcgcatgactgggtgagcttgtgccaggacacacactcaccaggaacagccctgagagagtaggggctgcaagaatgatagcggcatagccattgctcccaactaaaatcagagtgtaaaagggaagagaatttatctgcaaaaccacagggccacagagaggtcaatgaaaaagcttctaagcttgtttacaaaaatacgcaattatgtattaactgtcctgcgatgattgcacttaacacttgtttttaatctactcactgttaaccatttaggataagaaaggacgctggcaaggaggaaagagaggacaaggtcattgattacactcttgctctcagcccattgcagatggggtaatcgagcctcagtctccacttctgaaaaatggggaagataatgatatcactaagcaaagacttctagtgtggtgccaggcatggagtagcccataagggttggtaattcaggttctaatcgtaatcatgaactcctctctataaactgtctctcagatgcctggttaagagacagcttcacagcaaggctcacaggaccaagcaactattctttaggcaaactgtatgctcatccacccacctgaagcccccagtggacccaggaaaaaaggttcccaaaatgtgccagagtagtctgaggtgtcctgagaaggagcccctctgaaataacagctttagctagctctggtctggcagggcatcaggtctttaaaaagaaaaataaaataacttcctccctgagatgaagttgttttattttctctattcccatttcctggctcctctcctgggtctgctgtttggggggtccataggaattagcaacacatagaccagaaggaagcaagaaatataactttctactgctttctgggaatcatgatctatcacatctaagagcatagtttctaagcttcagtttcctcatctctaaaatgagaaaaatgaaagtaactttttcatagggtaattgtgaggattagatgaaatcatgcatgtaaagcccttgacatagtgcctgacacttaataatcactcaataaacatttgctgtgattattattcataatgctcacaatgacaaaaaacagtatgtaagtaaggtctcagagaggttaagtaacttgcccaaggtcacacagctggtaagcagcagagctgggactcgaacccaggcaaccagagtgcttccctatgctgcttccatttgttaggtagaaacagatcatcagcttcccattacactccagagacctgggcccaggcaagagatctgggaatggtggcttgggatttttccatggtcgatgaccaagagcatacaaatgctcatgcataaggtgatcagaaccaagggaacttaaggaccatgttttactgagcagagactttccaaacccaaatagtaagtctggactcagaccccagtctctcttcttccaatcaagtgcttgcttccaaaccacacttatgagatcattgttgccccacccaggtgtggcagagcacagttcatgaatgccacacactagctgagtaatctcgagtgccttacctagcagctctgtgcctcagtttccctatatgtagaatagggataaaaagtaatttgctaggttattgtgagaaatctgtaaaaatgccagcaacattctaggagctccataaaggttagtttaatctggtttaggtttgagtggattacttttgtttgatttccttatcaggcaacagaaatcctctccaacatgactgacttttaccttaacatcattatcttcccttttcagaggattcactggcattgaagagagtgactcaaggctgaggcttaccctctctcagcctgccctttccaatgttccctcttctctttctacttcccatcttgccagctcatttttctcaccagcaaagaccttttctctccaggcccacggcatgaaccctgcgcttccaaaggaagcaagcgctgaatagatttagcaggttctgataaatgtcacgtttattttggtgccaatggagtcactgcattttaataaaggccccacctccacctctgccccagatgttggtgctggtgggaataccacacgttctgctgccacctcgaaaatgaggttccagcaagtgggtgctggaaggtgatgcggagctgggtcctgccagctccctctctggcaagggggcactgtttctgggtggctagttctgccagccaagatttttatatgcctattttccaacttcagtttcctcatcggaagaaagcggatcataccctttccactctgtgaggtaaggcaaccgacgactgtccatggagatgcttagtgcctgttgattctaattgattccaaagatctaggcccctgggagtaggctgggagaggttggctgcgagagctgagctggctaagtggcagaagctgatgtgggtggctgagccagcagttttcccatgccagagagtgagagccacagattgggccccttctccaaaggccccacccaggaggggaatcctggcctgggacggaggaggggcagggagggcagggccagatgcatagaccttcttttcatcccagcctgaagtaactggggctatgacaaaggacacatggatctggctcccatcatacccccaccctcccaccccacccccactgcagccaactccaaatgccccagggctggagaactaatgaggtgatggactgatgttaggtggcagccactgagaatcgctcccacacacactgtaaaataaaatccaccctttctttgcattttgctgagcctaggtgttctctgagttcctattgtctgtgggttttgtgctccaaaagctttttttttttttgtcataatcatgaacccaagcctgcatgaaaacacagtataattagggaaagagaggggaagggtgagaggggcagggcatgtcagagggagaggttgggaacaatgtctcacatttccataggaaaccagttgggtgccctagtagcagaatctgagaacaggattccagggcaagtagtatatttaggagtggtcccaggaagcaccagtaggggactgggcaagtgagactgggaggggaaggaagtcagtcaaggatgcatggttgagaaagttaccaccttgggtaagtaggactccaacttcctggaaacctctaggagccagtatagatgtgctcctccaagttattccatctacagggagagggaactggggtatttatttactcactcccatccatcattggccgaagatcctcattaactctatagcactcctgacccaccaacactcaggcagagagtcacatgtactggaacagagaataccaaggaagagacatcagcagcaccttctatactatggactctataaaaacagcctggggaggtggccagagcatgagttatgatgtccattttagaagtaaggccactgaggctcagagaggcaaggagtttggtccactatcatatagctaggtagctacttaaaatgaaaattatctcccttctaaggtccaacttgaccttttccctgaaactactcattgctcatcccatcccagcagaaattactgttcccttatcatcttgtctatactttagttaagatgtttgtcatgctgcattgtaataaccctttcacctgtctgtctcctctgatcaactgtgagccttttctcaagtgcctaacacattgcaaggaattagcaaatgcttgtttcctctccttcgtgctccctgcaagcacagtccacgagacaggtaagtgctctatcaagttgcattgaactacaaagtaactctagaaatgaaattgttctcaggagaacagaggcaatagccaatgcagaaatggaattccaggcaggagaactggttatgaaaaggcacagacgtaggttttgagggaacccccaaggaattgtgtatgtgcaaatgggcagcagtgagagatgatgctggagagttgagtaggaaccaaaccatgaaggtctccaggccaaggaatggcattgccacagtgcacacagggaaggacttttccaaaagcttcagtaggtccagatgagccatcaggacttcgagtgggagaagatgcttctgcccagaacaaagtcatccaagctcagaaggagatatgcagtgctagactcttgagcagatgacaaccccactgagctcattaggtaggaaaagcaaggttcaaaacagtaagcagtatgtacctctttgtgtaaaaagggaaggaggtgagaatatatttgtgtgagcttacatttgcataaagaaactgtagctagtcactgagctcagtgggattgtcatctgctcaagagtcttccagcccaaagctggcagtttctgtgatcactgatcactgtgcgtctctaaggtggacaaagctccccatgcaccacattctaggagggaaggggaagaattaggacattcttgtggttgctcaaagctcagaaaaggaattaagaaccaatgaaacagaatctcttaaaaagagaagttgacactcagcagcagcctgggcaggacttatatcactgaaaaggagggcaaagggctcacatcagctttgttcccatactctatagctacaaatggcaatgtccaatcagaaatacagggtgaaaactatttattaacaaaagtttaggtttacttcatttctctgataattggatgatacacattcattgcagaagatgtgaaatacacagaaaaacacatcaaagaaagtaaaaatcacaggaaattccatctgtagattttcttcttttttaatcactatatgtatcatatacactttccctaaaattgggattgtgacataaacacagttttcttagcttcttcattcaataagatatcacagacattttgcccatgtcactaattattaatctgtgttcatttaagaagttgttcaatttccatcatatggacactatatttgctttgctcaattccctgttgctggacttttagattatttacagttttttactattatccatatcagtggagtgaacattcttctacacacaacttttcctgagattactgggtcaaaggctatgaattttttctttttttttttttatttgagatggagtttcgctcttgttgcccaggttggagtgcaatggtgtgatctcggctcaccgcaacctccacctcccgagttcaagcgattcttctgcctcaacctcctaagtagctgggattacaggcatgagccaccatgcccaactaattttgtatttttagtagagacagggtttcttcatgtttgtcaggctggtcttgaactcctgacctcaggtgatccgcccgcctcagcctcccaaagtgctgggattataggcatgagccactgcgcccggcaggctatgaatatttttaaggcttatgacatatgcttctaaactccttttcagaagatctccatccttgtggaacagagagtctagccctgtgctattcaatatggcagccactggccacatgtgattatttaaatctaaattaaatccaattaaaaactcagttcctcagtctccctagttgaatttcaagtgctcaatagccacatgtgctagtgacaactatactagacaaagcagatataaaacatttccaccagcatagaaagctctattggagagagctgctctacactcaagagaggacaaaaaggcaatacacaaaataactaagtacagtatgttagaggaaggtatctgctatagaaacagatcacagtaagggagccagggagtactggggtggggagggtttaccatttggataaggtagccaggaaaggtgtctgctaaagtgacatttcaacagtgacccataggaagaaaggaagcaaaccatgtagattatctgaaggaagagagctccaggaaaagggaacagcaagtccaaaggccctgaggccggagtgtgtctggcgtgttcaaagaagagcaaggagactaacatggctagagtagcatgagaaggttagaaagagctaggcaatgcagagataggcaatgcagccagagagaggatactgtgagatcatgtggggccttataaagccattgaaaagactttagcttttactctgagcgagacagggaagaattacagttttgagtagaatgctgttatctgattgacatttttacaaagtactttgtgactcagttgagaatagattgtagagtagatggaggacaaaggagaaagctaggaggccagagaggacagtgatgtgataatacaggggagagacgtgggtggcatgagccctggtgatgaaggtggtgaaaagtgattggattctggatatagtttgaaagtgaagcccataggacttacaggcatggttgcaaacaatgtgaagtgttacagagaaaaagcacagggatactgtgtatcactggtgagtagaggctgcttttctaagaaagcgaccttggggccaaaatctgagatccaagtaggagttaatttgataaagattttacagattccctgtctagtcatctgcagcctcctgacaatgagaggaggggagggaacggaatgggagaggaagaggctgccttctcctgggaaaggggaaaactttgctacaaaaagctggaaacagcccaaagagtcatgttttgttagatatgtatctgcaacccaaacagctttgctcttatgggcctgtttgtcatagatcagttagtgggtagattgcttcggctggaaatggagatttagacaatgccagagtggataatggtgcccgaacgctgtcaggcgctaatcaggactcggcaatgactctgctgtgcagattgaagtgcgagcatttggagttattactcaaggcttgtctctgcaattagatgattgcataaccttaatatgatcaatcttgccggatgtgaattgtgcagctgtaaccacaaaataaggtggcatttctgttttcttgttgaacacaaacattatatatgcgcaagtcataattttataacggtcgcttttggcaagaaagagctttgtcagtcagaagatgcagttgaggggaaaaaatatatatatatgcaatacaagtgcttaaagaggcggtcataatgtcaggcttcgccttgggaaatattgctttgcgggttttgcatcttctccttttttcctttgtacacatcaattttgaggccaggaagttgggaaacttggagctcatattgagccctcccgggacaacacagctttgcactcgcacatgcaccacgttgagagtcatagggaatcagcttgatattcatcagcaattgcacatcacaccccgttcatcaagcctcattgttcagtggggacgtgagctacgacttaggctcttcagattcgagatccttgcagaaatcttagcccgccccccaaggcccggcttgagggactacagggacacagccctcaaatgccctttccacctcacaggctcagggtgcgtcggaggggatgagacggatgaggggaccaatgctgagaatgtcaagatttctcttctgactctggcccaatttgcagggggcacagaactctgagaaaggaaaaaaaacctagaggttaagagttgttttgttatgggtcgtagcttaatcttgggaaaggagagagagagaaagagacggagatggggtgggaagaagggagcaaggagatacatttaagaatagcgcagtgtgatgggatgtccagagatgaaacctagtggccaaataagtgaatgcctaagattaggtgagagcgtgtgtgtgtgtgtgtgtgtgtgtgtgtgtgtgtcagagaaaaagaaagagaggaagtgggagaaggagggggagagagagagagagagagtatttaccaatagcatctgaccaagactgtaatttcatggctgcaactaatgacaaagtcaagtgtcgaaggcttagttctcgaggagacagaccctgagatacagatttgaatacaagtttatcggggagtgctcttgggtccacatctacagggaaaggcagcaggaatgggcagagggagagacagacagcaatgcagtcacaacagggcagtcacagctgatcccaagtagaactctaaagctggacgatccgttaaagccatcccaagttagggtaagtgggtcaggttgttatagccctaccttgaccggtcattggatgtgggctgacctgggaaggagtgtgaccttggatgctaggacggtcttcagccagggcaatttctacagagggctgacagctgagagctatcagctgaccactttccagcagctggtagaatcagtccttcgttcctgaatgaggggtctgggcagtgtagtagagcatccccaataacaagtaaaggatttgagggcaaggagaaataaaattgagtggaagccagtgaatgacctaaggtgtgaaagaatcaagtgtaggccaggaggctgatgttcaggctggaggagccaatgcactgctgggttccaagacagaggcagcctcagcttgggtcccttcattccaggccccagttcccccaaaccaaccacctgtctcacttgccaaatggccaagctgagtgaaagcaaacatctaggaggcagggcctgaacaggaggcaccccatacaatcagcatcaccatctgacagctcacatttgcagtgcacccagcatgttcaggactctgtgctacacaccataaggtcactgctgtcactaccaactttcaggacaggcttaggaggtagaaaccttcaaaaggcccactggagtcagagacattgttgggatccctcataaccagtgggtgcccaaccttgtctccaactctcgcttctctccagagctccaggtgcattttcctgaaggacccccctgcttggatgtgtgaaggactctcgaactcccatgtcctaaactgccccactcatcttcctccctcaaacctgggcattcctcctgttctgtgtttcagtaaatggcactgccatccacctcactgcacagggcagaacgtgtcatctgtgactccagctccctctcacacccccacacccaacatgtcctatgggttctacctccctcacaggtctagaatccagatacctccctccacaaccagtaagcctcccttctctccaggaagcaattctcccagttaaatcttcctgccttcaaacttatttgcctcctccaatatcctctctttggggagccagaagatctttctaaaatgtgagccagatcacaactctcctctatgtaaaacccttctacatctgctccattgtcttcaggataaagtccaaatggtttcccacagcaaaactatctctctgaagcctcatttctagatatcctctctcctcgccctgcatccctccctcttcaccatagcctgtacacacacaggtacttagactctatctcgttgctgtccaatcccgagtccatgagacacacagagcaactgggcacgttgaaatgtgcctagtctaaatcaaacggtactgtaagtgtaaatgtccctggattttgggtccctgtaagtaaaatggtccctggattttgaacactcagtatgaaaacaaagaatgcaaaatatctccactgggaattttttactgattacatgtttcaatgatgatattcagactaatttatattcacatttgattaatcaatttcacttgtttcttcttacttttttaaatgtgtggacactagaaatgttgtttttaatgtgcaggttcttattatccctgggttttttatttttattctttatttttgtggatacatagtagatgtatatatttagggggtacatgagatattttgatacaggcatgcaatgcataataattatgtcatggaaaatggggtacccattccctcaagcatttatccttgtgttacaaacaatctaattatactcttcattattttaaaatgtacaattagattattattgcctatagtcactctgttgtactgtcaaatagtaggtatcattcattcattctaactattttttgtaccgttaatgatccccacctcccacttcaacctcaccactaccctcctccacctctggtaaccatgcttctattctctgtctccatggattcaattgttttgatttttagatcccacaagtaagtgagaacatgcaatgtttgtctttctgtgcctggcctatttcacttaacctaatgacctccagttccatcctgttgttgcaaatgactgaatctcattcttttttatggctgagtagtactccattgtatgtaagtaccacatttcctttatctaattcatctgttgatggacactcaggttgcttccaaatcttggctattggaacaccagaaattttttaatgacaagtgtaacccacattccatctctattggatggtgttggaagagcatcctgccattccatcaatacctaggagttttctcagctcagggagcaagaaattcccctaagaatttaaattgacctaaagtaaattatatttcagagctttagcccctgtctttgtacggttaagaggtagccagcaatggggccttcccttttcaggcactggtaagccctggccagactaaaagcagaaggaaccaaagagaggctacagagttctacacaaaaatttcaagggctgtccgctctgtgagccaggaaagctgtgcagcatgtgctggaatgaggaaagagctaggcagttgtatctctgagaattactagttgttggtagatgagtgttatgtgggagtgggtgtggcgttcatgggggtgggagtggggaattcagtgtcctcagatcagggatatggggttgcctgaacatggggagtagctggtactggactctagagagacttaaagagaatgacttttttctcttacaagaagtaaggaataggcctggcatggtggctcatgcctgtaatcccagcactttgggaggctgaggtaggtggagcacctgaggtcaggagttcaagaccagtatggccaacatggcaaaaccccaactctactaaaattacaaaaattatctgtgtgtggtggcacacacctgtaatcccagctgctcaggaggctgaggcaggagaatcacttgaacccaggagatggaggttccagtgagccgagagtgtaccactgcactccagcctgggcaacagagtgaaacttgatctcgaaaataaaataaaataaaatacaaatggcaagaaggaaggaatagaccttaagaaaggcagcaagccttagaagccccctcagagcacccttcttattattgatacactattctttctggaactccctggacagtcacactttacataattttaaatattttatcctattttgctatttctgtccggttccaccaacacttcagtaaagcctaccatcctctgatagccttgtagcggggccaggtgaaaaggaacggagttacagagagcaggaaagggaagaatggtctcctcgctctggcgccccgcattgatacagacacacctctcagactccagggatgagcaggggtccatggcacagccgggagcagccaggaggagccctgagcagggagctgcaaatgaatgggacgctgggagcagctgccaggcaaacctcggcttcctcgtctaccctggagaaaactgatcctggaagggagaccagctcttaccccatcctgctgcctcttctgcatggactgcccttccttccctggctgccacctctctcacttgtcttcgggactcagttgagacatcaccttttccaggaagtcgccacagatgccctcagtctgggtgaggtgctcttcctcaacattttttaataaccactcctgactccactgtcaccgtctgcctgcttgactcacttcctcaacagtgagcaccttgagggtaggaagcataactttgtcatcccagtgcccagctcaggctctaatacatagtaggtcctcagcaaacatttgctgagtaaataaatgacaccagagagatattggataaaagaggagcatccccctcttcaccccccatctgagattcagcttgccctggctccaagaaacttctggtttccagcttgactgtctccattttcaagaaatatccccaatctatccaaagccctaggacagaagtcgatgatgggcatatgtttgaaagccctctgatgagagagtttttcctaattcttctatcatttaaacaaactgggatcctgattgatagaggaaccatttttacaaagactgggaaaaatggcttttaatatcagtttttaagaaagaaagtatagcctctataaactgttaaacttcactttattgaccataaatctgtattttgctcaatgcaaaagtttttcatctcgtacagaaatatgctgaaacagcgacaactgctgaaaacaagaagttttctcttacgaacaatttatatgaaaaagttattgaatttctggttagggaggccaggccaggcatcttgtggctccccctcagggccaggccagcgggtgccagacatgacccattgctgatcaatgtcaagagaaaattaaccaattgtaagtctattaagttgtgggctccagggatttcagagcccagagcaaagacatgtttctccctgaggaccttaaactgaggctttctttgctcagccagcctttctgccaagaaaaggaaagaaagagataacattggagagcctctaccagctgctaggtgctttcacaagtattgtcttatttaaccccagcaggtaggctttatcggccacattttacaaatgaacaaatgcaaaattagagaggttaagaatttattcaaagcctcacagcttgtaagttactaattactttctctgagcctcagtttccccatccatagaataaagctggaagtgcttagcccacgactggcacagagtaggtactcaggaaatgtttgctagcctcctaaaatcagaaaagtgcaaagcagtgttttgaagataagtttgggtgactttaagactcatattctttccctgcagaacttgcctttttatcagtctctctgaaaccaatcaccttcagaaagtgggataattatatctcctgtgtacacatgggacaaaggagcaatattttatatttacaaaaaaagtcaacaaaagaatggacacttttacaaggacctagcaggttccttcaaagtacttcctcctacatattccagtgccagaaatttcacaattagagctatacactcttgagttaaggcgttatctcatgtaaaagtgaaaatattattggtcgagttaagattttcttaaagtcatcatatcggagctgttaagagtccccagaagtatgcagtgcaagaagaacatacaacgtacgtccagtaagccaagtcctactgattggttgtccctgcctggaaggatgtgttgaaaaagattctgaggtagaatctaggctccgtggggaaaagtgtagcattctatcagtaaggtctgctttaggcaggagagcaacttggcagaaaggcttatgaaaactctttaactgtctactaccttccactctctcctttcctcttgccacctcgcagagatacagtcctattatcccccagttcaatacccttcaatttacctgtaggacaaaatacacagcccttcatggctgctcctgcctctctctctagcctcaccatctatcactcccttcatatgttacaccctagcagcaccgaactactttaatttaccccatacactttgtgtttttcagaccgctctacctagaacagcttttctcaacctgcccaagtgacaaactcctactcagccctcaaaacctaactcaagagtcaaccctgtgaagccttcctttactcccccagtagacttaggttcttcttctccaatgccccactgcacattgtacattcccaaataaagcctttgttgcactgctagactgtgagcctcttacagaacacagcatctaattttcctctgtgccttgatcatgcagctcagaacctaggacaataaatttttgtgtgaatgaatgaattgatgaagaaataattttccctccacaatgcatatgcttgttcatcaacctttgaaaccacactgacctttcaactatacacataattctttgacaaacattaatggaggtattgctaggtacaaggagtgatagaaacagacacaattattgccctcatggtgcttatagtctagtgggaaagataggtaatatatgggaaacagccaaatagatatgtaattacaaaataagaaagatggaatgaggatgaacacagcactgtgatgtggatcatttagctggaatgttggagaagataataagaacagatttgcaggatggaaaggagccagctgtggaaactgggggaaagggattctaggcacacagaaaagatgtgccaagttttcaaggcaataagagcttgatgtggctgacgctgaaaggatgccatggaggctggagtgtagtgaaggaagggaagaggagcttggaataaggctggagagagaggaagcagcccgatcatgcaaggccttataaaagtaagaagtttggatttcatgctgagggaaatcgggagccatggaagggatttgaatccctggttcatttactcattcagtaaacattggctgatgtatgctgtgtccagatgctgggctcaaagctgcctttgaagaactctcaggtcagaggagtaggcacagcagaaagccatcactagcgaacatggtggtaaatgctgattaaagcctatcctaaaccagccaagagggattggggaagctttctcagagcatatgacaaaggcactgatcctacagaacgcacagaagcatttcaagtgaacaatgcagtggtgagctggtgccagctaatacctgcttgagagaacccaattatgtgtatttctccaactctcgtttagggacaataagttgaaagcttgaaattgaccatggtggaagcatttacacctgggaaattggaaaacgctacaaattggggtgggcttctttgcttgtttgttcgtttgttccagcacaccagtgggggtaagcattaatagtaccgggaagatttttgatgtgcataatatggagcacagaggaaggtaaggataaagtcaaaggccgtgggagtacattcctgggacaaaaagagatcttttgagtaacaggaaggcaaatccaaaagacctgatttgggatcctagatttgccattttccagtggatcatcttagcaaatcatttcatctctttcagcctcagtttcttcatcagtaatgaagattcaacaatatattatctataaaacacttagcacagtgcttgacacatagtaagtgctcaacatgaatattagtctatgattttttattaagtatttccaggataagaagacaaacattggcatcaattaagggaaaatcttctaatcacatctgtccgtgaacgcagactggaaaaggccagtcctctgaagagaaatggtttacaaaaacctcaaaatttaaattttaaaaaccctcaaaattgaaatgcccatgtgaaagagcagaagatggaattaaatgagagaaatatatgtaactttctcagcacagttgccggcaaatagtaactttttagtaaattgcaatagtggtggttcttattttcagatgggtaaaagtgaagagctcaaatgtaaagaaatcaaacttgaatttgaaaaggagaaaaaaatgactgtctatattaaagtataattttacataaaaggaaatctatcaatttcactggtaaaattagatgaaatttgacaaatgaatacagtcatgtaaaaatcaccaaaatcaagatataaaacatttcaatcaaaccaagaggttatcagtccccaccaagaggcccctggaaactgctgatcttctttctatctctacagctttgacttttgtagaattttatatagatagaattataaagcacattctctactatgtatggcatctttcactcagcataaagcttttgggattcattcatgttgctgcatttgtcattcagtttagttgctgagtagtattccattgtgtggatgtaccataatttgtttatttaccacctggtggatatttgggttgtttccagtttgggaggtgttatttaaaaaaaaaaaaaaaaaaaaaagctgctatgcatgtttaaatacaaatctatggacaactgtattcatttttcttgggtaaacacctacaattgaatttggtaaattttcttggataaaggtacatttaactttagaatcaaatactaaacagttttcaaagtgaatcgaacattttttaaattgccagcagcaatgtatgtgagttccagttgcttcacatccttttcagtgcttggtattgtcagttattaactttagtcattccagtgggtgtagtggtaactcattttgtttttaattttcattcccctaatgagttgaacatcttttcatatacttatttgtcattcacagatcttctttgataaggtgtttattcgaagcttttgcccttgaaagtgtcttttaaaaaacaaagatctttaaatttgatagtctagtttatcattttttttgtagttcatacttttgcatcctatttaagaaatattttcctaacccaagatcacttagattttctcctgttttcttctagaagttttatagttttagctctgatttatatggtaaattacattgattgatatttgaatattaaaccataattgcatttctaggttaaaccccacttggccataatatattgttctctttgtgtattgctggacttgactggctaaatttttgttaaatatttattgatatatgtttatgagggatgttggcctgtgggcttattttcctgtaagatctctttttctgatttcattttcaggacaatactggcttcataaaatggttggtgacaggttttcttcctcttatcttttctgaaagagtttgtgtaaagtcactatttttttttcataagtgttttgtaaaattgtttgtagaaaactatttaaatgtttcatagtagccattcagatctggagttttccatgtgaaaaggtgttttccatgtgaaaaggtgtttaactgtgaagccagtttctctaatagatatatagctattcagattatttatttttgtgtgagttttgggagtatgtatatttaaagaaagttgtctctttcgtctaagttatagaatttattggcatgtaaccgttcataacattcttctgttgccattttaatgtccataggatgctctctttttaagttcctggtcagtctggctaaaagtctattaaccttcttagtgtatgcaaagaaccagcatttggcttcattgatttttctctatttctctattgattcattgggttttgctctcatatttgctattttctttctcctgcttactttaagttcaatttacttttttgtattttcttgtaatggaaactgacatcattgattcaaagatttttttttcccaatataagtgtttaatgcaataaatatctctctaagcacagctttagctgcatcccaaaaattggatgtttctatttgctgtcagtttaaaatttttactttttaagtttcttctttaatttatggattattcttaatgtgttgtttaatttccaaatattttgggaatttccagatatctttttgttattgattagaagtttaattcttttgtggtcagagaactattttgtataatttcaattctattacatttattaaaatgtgttttatgacccagaatatggcttatcttgatgaatattctgtttaagcttacaaggaatctggtattcttctggttttatgtggtgtgcttaataaatatcagttagaccaagctggttgattatgttgttaagatcttatatatcttactgatttactgtctatttgttctatgaattatcgagagaataatattgaaatctccaactataacggtggatatgtctattttcctttcagttctagtcatgtttgcttcaaatattttgaagatctgttattaagtgcatacatatgttggattgttatgagctcttaaagaatagattcctttattgctattaaatggctcttttctttcctaatattcttctatggtctgaagacatatgtccccccaaaatttttatattgaaagcctaacccccaaggtgatagtataaagagaggagccttttgggacctgaacaggtaatgaggccagagccctcacaaatggaattattgccttataaaagaggcccaaggtagcttgttcactcctttcactaaagtgaggaaactgtgagaatgtgctatctatgaaccagaaaataatgaccccttactagacactgactctgccagtgccttgatcttagactttctagcctccaaaactgtgactaataaattctgttctttataagctcccagtttatggtattttgttacagcagcagaagttgactaaaacatattcctagctccgaaatctactttgtgaatgttgttgtaactactcactttttttctaattgctgtttgtatgaaataccttctatccttttacttttaatttatttgtttctttatacttaaaatgggtttcttgtagagagaatattcctggggtcatcttgcttttttagtcagtctgatcatctctgccttttattgtttgtttgtttgtttgtctgtttgtgacagggtctcccctgtcatccaggctggagtgcagtgacatgatcatggcttgctgcagccttgaattcctggcctcaagcaatcctcccacctcagtctcccaattagccagaattccaggtgcatgccaccatgtccagctattttttttagagacagggtctcactattttgcccaggctggtcttgaaccactggcctcaagcaatcctcctgccttgacctctcaaagtgctggtattaccggcataagccaccacacccatcctctctgccttttaattggagtgttcagagcacggacatttaaagacattattaatataggtgtgtttaactctaccatattgctatttgttttctatctgtcccaactgttttttgcttctttttcttctttttctgccttcttttgcagtaattgagtactttttatcattccattttatctttattttttgtttctaggcttagcctctctgttttgttggctttttttcttttaatggctgctctaaggtttaaaatatacatcttaaattatcatggtctactttcaaataatattacaccacttcatgtatatttttagaaccttacaacagtaggcttccattttcctatttgtgttttttgtcttgattttattgctatattataaacctcacaacaaatcgttgttgtttttgagaagtcaattatcttttagataaaatttttaaattagaaagaaagccatatttgcgattgtcggtattctttatttctctgtgtagatctaaatttacatttgctattattttacttcttcctaaagaacttgctttcttttagtgatgacctgatggtgataaaatcttttagctttggtttgcctggaaaatgtcattatttcatttttattttcactagatacttttgctgagtataaaattttaggttgagagttttcttgtttatcctttcagcactttaaagatattgttctactatcttttagcttgcatgatttctgacaagaagtatgatgtaattcttatgttcattcttttttttcctctggaaagaaatgggtatagcaatctttatagctcatacagggcttggaatagttcatgttttcctcatccatgtatattaggaattctttccactgtggctgatggaagcacaaactgtttccagccctgtatgagttataaagcttattcctttccagtggttattccccagccacaggtagcttccttatacatacttgcagatcattaatcaattaaagattcaaaaaatccttctgtaatcaatatctctctctctctctgtcacacacacacacacacacacacacacacccctacatgtgtactctctctcactctttctagtagtttctccctgaaaattctagcaaaattggcctccctgaaatctaaactctgtcttctcaactcagtgaaatctctggtctctgactgggttttgcttccctgcactagtttgaagaactctccaggaaatgatctgaaacaatcataggcctcacctcatttgcttcctttctgtaaggaatactgtcctgcactatctgacatccaaaatctgaaaactttaatttatttgggtgtttaattatttaaagcaagaagggaaatccagtcccatcatgaccaaatcaaaaatctccccaggaggatattttaaaacaacagaacacaagaaaagatggacaaagtaagatggaatgcaaatagaacaacataaatgattaataaacattgttgagttaaagttaaccagtaattgactaaagacaatttaaatattttattgggagagatagccgctgcctaggacaggaggaaaaggaagtatagtcatgctagcaatacctctaagtttctgaacatgtcgcagcaaaggaaggtctgtggaagccagtcagccaagattctagtgaaaagatgagtcaataagctacaacgatcaaaaagaaaaagagatgtagatgctcatttataggaaagaggaaagtgagaaagaagagaattgtgacttaggataaagttttccagggaaaatagaaatggccacaacttctgaataagatcaagaatcatgagatctgaccagaaggtacagttccctgtggaaggaagctggttgaagaagtggaagaaagcattgaaaatttaagtgtgttcagtcattaaaccatggataccaaatatgtaatattcctactgccatttctctctctcttattcatgacagacattactaaacaactatggctcttgcatcaccaagcccagaggctgcctttgaacatttctacatatcatcgtaggcagcttctaccaattgatcacggttggcttctaagtgaaaatccatttttctcaccagttttaggcacttttatgccatttttgtgatagtcttgttcacctagtaataggggaaaaatgaaaatatgaatttctaagtaatcaagcataaatatgtacattatttggctcttaatacatatgcataacatttatatatgtttccataaatatacaatatttttataattaaaaacctattaggatcaaatgagataagaggtgggagaataccctgaaaagagcaaggttgtgtattttagaagacaacaccatgggacctctgtcatttgtcatctgctaagattcaggaaatctgtgattgatctttctggatttctgataaaattttgtatcttctgcatgtctaatcgcctccacagctatatacaggatgatcaactatcctgggctgcctgtgataaagagctgtaggatgtaggacttttagtacaaaaactgggaaagttctaggcaaactaggacaagttggtcaccctagatgtaggtagggaacaaatcaagcagttctcacctccctgggatacaagtcatggaaaacttaggatcacagagggcattggtttttatcactgtccaaacctaggcccccagatccccttctttcctacaggatcccagaagagatttcacaccacacccccactctgctgctgctcctgccctccctccctgccctccttccctcaggtatgttttgagccatagaagctctcctgctcctcccaagtctagagtattttcacccgtcaaccaatgaatacagctcttttcagcctccaaaaatcagccaagttctccttgtttttttaccagcctttcctctcatgattgtactcacctcctcctccacaacactttttaacaaagcaaaagagaaaaacaaatgaataaaaattttaaaagagagtgcctattttgtaacagttcctgagctggctgcttagatacggggcacaaagataaataaaatatggcccaacccttaaggagttcagggctaagagcatgagggaggtaggaagatggatggtacacaagtaattataataaaatattataatagctaatatttattgagagcatacttttgtagcagacactgtgctatgtgctttaaatgcattatttcttttaatcctcacagtagccctaggagataggtgtacgagtattattattcctcattttctacctgagaaagctaaggcttaggccagttaaatcatctgctcacagtgctagcaagcactggagctggattcgaacctcagctaaccacaaaactcattctgttaactactgtgttctgctaggatgcaatccaaacaaaatgttgtgaagactcaacggagggagaatgctctctctacctggtagaagagcaggcaggaaggcgccacagaagtgacttttgagttatatctttaaggataggaagttcaccaggtggacaagagggggagacaaagggcattggctcacgagagagctcctaatattcagaggaaaagtgattttctagcacaatgattttagccatggatgcatatggggagagctgtgtcaaagggccaggggtgagggacagaagtcagatcttgagtgctttcttgctagggtgctttcttctaaccccagaagtgatggggagccatggaaggtttttaggcaggagagccatatgattgtctttagaaaagtcactgtggcagtgatggatttagggtgggagatctgaaagctgaaacaattagctaaggaagggccagtgggattaatgagagttaacagattcaagagagatttagtaaggctgggccttgtgcctgattggccttggggaatgaaagtaggaaaggtggaaaggcaggatatggagaataagagaattcctagcctaagagaataagtgaatggtagtgtcatttgatgtgagatgaacagaggagaagcaagcttagagagaaaagtgacactggtttgaggtgtctgtgagatatccaaatggagatatctaacaggcagttggatatagagtaagagctcaggagatagggtggaactgaaatcacctacctaggataagattcttgggaacatttgagtggtgcactctcatgtcccactttaaagtgccccatcatgaaataacaaccaagaccccaagaaccttctcccatcactacatttttcttatccttccagatgcccagtggagggtggagtacattcacttaagccccaaagtcttacttaaaactttgaagaaattcctccagaattctagaggccataactatggtaccttcatttccttgcatcttcacatgtttctaataattttttagttagaaaaaaagtaagtcaagggaatgaacatggattcagcaattatctaagcaagggaccaccctgtgcatgggcactttccatgagttaactcaatcaagcagtccttacaacagtcatgcagtcttattttccccattttgtagatgagaagtttaaggctcaaagaggtctcttagcttccttaaggccacaaagcaaataggttgctcaggtatgttttgaagccagatcgacttcatcccaaggccttagccatgacatcatgactcccaaatgtctgccacaaagtactgctggtctataatcaaatgagccaaatgtcttatactcttgcatgactattaaccaccttttcttgagatggacttttctttgaaatcatgctcttcctatgggcaggaagcattaaaacgattctgctgcaatacggttgtttgatttctttgtgcttcatgtccttacttggcaaaataaaaagccggcagctggccgggtgcggtggctcacacctgtaatcccagcgctttgggaggctgaggcagggggatcacaaagtcaagagatggagaccaccctggccaacatggtgaaaccctgtctctactaaacatacaaaaattagctgggagtggtggcactctcctatagtcccagctactcgggaggctgagataggagaatcacttgagcccgggaggcagagcttgcagtgagccaagatcgtgccactgccctccagcctggcaacagagcaagactccatctcaaaaaaaaaagaaaaaaaagaaaaagtaaaagaaaaaagaaaaaaaagttggcagcctcgtgttcgtcctcaaaatattcttttaatattccctggtccatgaagtccaaaatgttggaaactactgtaggacctcttgctgaaaccttgacgtttgaaaaagagcagggataatccagcccatcattgtgactgcatatgggggtagcagagacacatgggattcttgctgtcttagtaagggccgcttcacgcctgccattccagggctcaaaccaagaatgaattggcaaaagcctttacatgcactagcagcttgctgtgaacccctgagattgaaaaaagcttatcctccaaatattttttttttttttttgagacagagtctcactctgtctcccaggctggagtgcagtggtgtgatctcagctcactgcaacctccacttcctgggtcaaagtgattctcctgcctcggcctcctgaatggctgggactacaggcacacaccaccatgcccagctaatttttttgcgtttttagtagagacggggttttaccatgttggacaggatggtctccatctcttgatctcatgatctgcctgcctcagcctcccaaagtgctgggattacaggcgtaagccaccatgcccagccccaaagatcgttttttaaattccattccttgttgttaagacaagatggtgggaattaagagattaatattaacaaggaatctgatgatatgcgttttatatcctctctgtcccagacaagtgctctacccagagcccatgggaggagaggttttctctaaaatctttgaggtcaagaaacaggactattttgggattccaggattgaaggctcctttgctgttccccagccatcaggtaggagccctacggtgctctgatttttttctcctctgtctggctgtggctttctgtgctcgagctcttctccctttccttcctagagaagagtctgcatctgtggggcaacatgcaacaactactgagaccttaagttaagtgctaggcactgtactcggcaatttcaagcaagccatttcaactcatcttatttattttttattgcttttattattttaaaaataatgcatgcttattttattttaaaaaaaattttaaccctacatacatgaccttggacaagttacataaccttcagtttccttgaccacaaaatagggacaagaaccaaacaatattgtgggtgaaaatgccccattttaccttcagagacaatcactattaatactttggtggatatacccaaggcactttactatatatttatcaacatttattactaataatttttataagaatggaatcacttacacaattgcttgtgacttgttttctcaggaaaatatttgcatgttaaggtacatatacctgagaatcaggttttatcaacaaactggtggatgggaaaactgaggatcatggaggttgtacagtccaaagagtcaggtaatggaggcaaaactcaaatttcacacccttgctccaaaacccttgttttttctactaaatctcaggttcttagaaaataaatcacagtgggaagagggtccaaccccaaacaaggtgagactctgggggcaaaaatcatacagtctgggggtggtgccatgtagtggcagcaggatctagaatgatgtcagaactggagtcagaaagcctcagttttaagattgacttatactagtttatgacattaggcagttgaataacctatctcagcctcagtttgctctgctataaaatggaaataagaatagtgtctgcttcatagcattgctctaagggttgaataaagagaacacatgtaaatggcctggtacatttctgaaggtcccatcatgtatctggcactgtgctaggctttggggattcaaagacaagtgagacacagttcctgacctcaaaggatcgacagagaagacatctgtgtgcccccaaagtgtcacaggggctgatgtagacacctggctggagggtcttttgggggcaaaaaagaggacaggtaagcacaaggagaaggaggatttggatggttaaacaacagaaatttatcttgtcaccattctggagcctggaagtccaaaatcaaggtgtgtgcaggtttggttccttctgatgcctctccttggcttgtagaaggtcatcttctctgtaccttttcacatcatcttccctctgtacatatccaaatttcctcttcctgtaagaacaccagtcatatcggattgcagcccatcctcatgatctcattttaacttcattacctctgtaaaaccataatctccaagcaaggtcctatttgtaggcactgggttgggggttaggactctagcatatgaatttgggggaggtggaggacacatttcagcccataacgaaggcacactctacacagaccttctgctgctagttttcaggagtggtttgtctttctggtcagtgttgtggtcttctctctactttgcatctcactgtctgttttcactctccctaccttccttacccaattgaggcaacaaaggaatcctccagagcttttagactacagtataaagtatcaaagtccaggctcagtatacagtggcctcatggccaaatctcatgcctccaacccaagctgaaggaaaggaaggagagagtagatcactctgtattagcactttactgtgagcctgtggctttcccgtgccttgtcttgtgtgatcgttactacaaccctgtttataaagacagaatcagagaagccaagcaatttacactgtgtcacaaggctggaaagttgatggagcaggattcaaatccaatctatccaccttcaaagcgtatgttatttatttactccactttccttgaagagttcctatccctaatctccaagaaatgtaggcaaatgagagagattccaaaagtctggagcatgaaaatcactgccttcagtgtaagtatagattccaaaaattgtagacttgaaagtttggcaaatggagttttcagaaaattcactgagatgttctctgttttccggcagcttctctatctcaacccaacccagttcccaatctcccctgagataaggaatctcaaagattggagtcattctttgaatggaagagaggaaaatgctgcaggagcaaacacaaatgtgacaacagccctcgtaagtggtccccttctcttgctcactctggtatttcttcccagagcagccaaagggtctttcaaaaaggcagctctgagcacctcactcttctgcctgaattcttcagtagcattgcactgtcattcagaataaaatgcaaatttttcaccatgctcaccaaggcccctttccatttgccctagacccagcccctgtcttatctctttctgcatctcttttgataaacacacactccagttatatctgagggcagggaccatgccctcccctgccagttcctagaagagagaaggcactcatcaagaactgggaaataagtgaatgaggggaaaaaatgaatgaactgcaagagagcaatgtgggtatttctggcttaatcgttctcctccaggtcatggctcagggctgagagcccttccacctgtatctctggccttcccgagatccttaaagtcctctccacccagccagcagatgaagaaagagaggatggatctttgcatggggagctgtagggtctggaagcagtgtacatcactgccatccattgtctatcagccagaatcagaccatggccccatctagctgcaaggaaagctgcaagcctaggagatagaggaattgggactgggtagacacatggcagactctggcaaggcctcagcgttttccatccacacctaactccaaactccacaaaagcctcctcagcacttcaccagagtggactcttcttctctcccctgcctccttgtccacagccctctagcccattttctctgcgtcttgacctttcccaatgtaaaactgttcttatctgtgtcataagaggtgggaggtaagggagagagcagcagcatcatttccttggagggcaaggcatgaactatccccctccgcaccctccccctgcccactcccaacacagctgtcttagtccatttaagctgctgtaacaaaataccatcaactcggtggcttataaacaacagaaatttatttctcaccgttccggaggctgggaagtgcaaggacaaggtgccagcagactgggtgtctggtgagggcctacctcctcattgacagtgacttctccctgtgtcctgacatggtggaaggggtaaggcagctctctgggacccctcttataagggtgataaccccattcatgggattatcatgaagtctccaccctcatgacctaatcacttcccaaaggccccacctcccaatgccatcaccttgggcgttaggatttctaaacatgaatttgaggagtggagggacacaaacattcagactgtagcagcagccaggtgtcaggtgggcacacagaggagttctttgcagcttccctcacaccaaggtctacatgtgtctagaccacatcaccagccagactggccacatcagtgtagatatgtgttgcacaagaatgtccactttctaccaagaggcatgggaggttggctgacccttccccacatgccctgacagccccgctgataagagggagcggagggactgaaatttcactttctcagaaacagcggattcagcaactgtggctgctacaggagacacagatctgcaccagcttaatttctctcagcctttatcaccatacacaaagcaagagctattatgccctgtccggcggccaaggactcacctcgtctggcattggggaaatgatatcttagcctgcagggccccagacagcttcttcttccaacactattgtggctggaaccctcacctgcccgggggaagctgttcccatgcaggatagacaccattcttgccatgtagggctcctggagaagtctcttctagaaactgagccagctttgggccccatagagaggactgtaacagagctaacatattctggagacaaacccccatctccacacttgcctgagccctgagaagttggggggaaaagcctctccaggagctcctggaatagtttgagctgctgctgagaaggaatgactgccttccgggggggatttagtctccacacttggcgatcctgagtccgtattaaaaatgcaagactctagtcagagcctaccagatcctgccagccttggttgggaccctgaggctgggtgaaggaaggtgaggggaatcagggagacagggaggaaggatggtgcctccagcaccacctatccacagctgatctcctgcctccaggactccatctcaatctggggctgagcttctggctcctactgtcagggatccctgaacagtccatatattgtgtgcagctcacctttgccctagcccctcctcactcccataatccaaatccatcttctcctccaccaccctgtcctttccctacagcctgagaaaggaccctcagtttacctggtctgaggcatcctccttcttatagcttcaggcgaggatccatagggcctgtctgttcaaacccacttaccgagtcccctgaaaagtcctaaatatttttatttcttcattcctttgacaaaccctctctgaacccctaatttgtacacagccccatgctcagttctgaaggtaaaaatctaccagtacctactctctgccctccagaagctcttaaactcaaagaaaggagataaatgcaaaaacagtgacattaatgaagtcgtgttcaatattttttgagcacctactatgagccagaccctgtaaaatatgcaccacaatataaagatgaatatgactcagtctgtggagaagaaacgtcagtatactatctctcattctgctgcaagttcatcccaagaaactatggagagcaaaaaccacccttgctccaaaaccttccagggggttgtttgtctgaagcatggaagacattttctgatggttgggagttttctagcagtgctgttggtgcctcacttgtgtctgtaaacatcaaagcttcttactgcaagtacttgagatgctctcctgcgcatcttccctggcctaggtagggtagaccagaagaaccagagaatttatgtccctcccaccccagaccagccctcaaccagtgatgggaggaagttagcaactaagtgttccagcttaatctctcccagtggcagagggctagggcaactctgaggtgtgttctgccttgcagtccccagcaagatggtgtcccagttgcccaaagcaacaacctgctcattaattcaccttatattggcttccattccttccctgtcttactcacaactcccaacccacgcttcctgggatcaccttccaaataaaccccttgcacctgaattcttctgtcaaggctgctgtgggaggagcccagcctaaggaagattctgaaggcgtccccacatcctggtctccacccacatggttctctgccccagcgggctacattctcttccttaagcacaccaaaggcattgcctgagcttggactgcactgtggatccaacctggagcctccaccccagcccctccatacaccacttgcaaacactactcaaagaatcctgtaggctgagagagctagctcatgcctgtaatcccagcaccttgggaagcaaaggtgagtggaccacttgaggtcaggagtttgggaccagactgcccaacaaggtgaaaccccgtctctactaaaaaataaaaaattagctgggcatggtggtgatgcctgtaatcccagctacttgggaagctgaggcaagagaattacttgaacccaggaggcagaggttgcagtgaaccaagatcgccacaccattgcactccagcctgggcgacagagtgagactccatctcaaaaaaaaaaaaaaaaaaaaaaaatcctctatttcctctaaggcaagttcaacttctgttgcttccacagagccattccagccactcctgccctggagcagtaatgcacatgtatatttgtaggtgtgcacttatcatctctcccccatcccagcatgctgagaacgctaacccttgctgcatagattgaagaaagacacagggatagttgtggggcggtgtgggggtgggggtgaaaatgctgagaaacatgtgatttctttacttctaaaaccctttcttgaggaagagaaaaggatagatttaggagagggagagaaggggccagagccagaaagggttcagtttgagaaagaattgggaggtggtgtgtgggtgaatgggagatgaggcggaacaagaggagtcagggatcattctcagcctgaaatgattggctttggggagaaaatgaatttttttttaagttttgcctcctgtgaagccagcctctctttgctactttttgaggcttccataaaaagatcctctttttttgtggacgttggcaatgccacggtcacaaaacgggtcagctttatgcgaccccacatcttgaaatctttaaatggaggttaaaatctctattttcaccagaaacagaggcccaatcttccccaagttcctaatgacttcactgtccaattgtcctgcctccctctttcctgagctgagggacaggaggggcagtgggtgtcctgggcgcatgtccattctcctcaagccggagccagcgacgcccacaccctcccagcccctggtcccagccctctcccacctcaccctgagtctgacaagccaccctaatggattgaccgtggcctctgctggaggggctaaatataaaactttcctgcgctcctcttgtcaaagttaaaagcttttcatgtctgtgttaatgtttttttctgtctgctggctccagtgacagatgcggcatcttgtgctgagtaactggagagtgaatggctggcaggggccggggaggtagcggtaatttatctccaagagtttaagcaggatgacatggctgggaacagaaggggggtgaggttgtcacctgattactaattccaagatttctcctccaagagggaaaaggagtgagcgaggatgaagggtacaaaaagcaaatcaataaacaggttagcgtctgcgtcattattaactctcagcctgtcagcaccccactgaagcgatcgcttgaggcggcctcggatttaatggtcagtgcaatagatttactgtaaatgttatcagaggcaagggcgggggcacggggcttgaggaggccttcactgacaaatcattggattgcacctggatgcatgaagccatttctgaacatgcataaataacctagagcttaggtcccgggtggcatttcctccctcggatttaaatgctgctactcgcctttctctgtattcttggcttccaaaaggttcaaacagccaggtttcccctaaatctttccaggggcctcatcttctggccctcagcaaatctgagaaaggtcaggcagcaagtctgcaccaggagcctctgggatccaaagagatcagcgagccaggaaacagcccagacccaagaaaggcagccagccaggagtctgaggcttcgctgcagcaggtgagatgcctctgaaagctcagtcctaaaggaagcattccctgagctcagcatctagggactggggatgccttcttgaggttcctcctgacctctccagtgagcctctggagcctcttcctctgagcctctcacctgctatgcttactaacaacaaatactggtgggagggcttttgactaagatcattcatcagaattcaggttgctatcctaccctcatgccaggagtcatggcagaacaagaatccagaagcaggtagagacagcagccaaagagcatagtaaggtagcctactgttttcaaaagcagggccactgtgtacagttgttcaggctgtatactgcacaagtctaagggatgtcattcacaacaaatctatgggaatggtactctctggagctgtgcagcatgacaacttcacaggcatatgcaacagtcccaacaaagaggcagtgccaggtggacaatggagagaagcaacctactacagaagtgaacactgagaatctttccagtagattccagttgaaatcagaggggacaagacaagttgccaggcataggttgtctaaacagttgggagggttttaacagtgtcctaggaacttggactattgagaactgcttctgctgacacttgaatgagaaaaagcctgtgggaacattagggaatgcagattttgtcttagctacactgaccataatctttcaaaccaaatacgcaggatttttgttctactgatggtgatgaaaagcttggatacaaaaatactctgctgtctcaggcattgagattgttcccggggtcagaggcagaacacatggcatctggactctcagaagtaacacaatgagatggaatcaaggaaggggccgactcaagaccctctctctcctcatctcagacaaggctggtgttagcttgagatcctcccaaatggagtccctaagacgaggccttggaaggaggtctcttgactgggaggtgagcccagaaagcaaaagtgagagagaaaagccaactaagggcaggttgatggtcatgcccagggcattattccccgacacacacttcaaagtggggcctgttggaggctgagcaagttcctctgggaccagggaaagccccaaggcatgggaaaaaagagactcttaagcaagagataaagggaactgtccacagcagcaagtggatgcggggatgggggggaccacgggtatctgaggggaagacatcaatcacatcttctataggacccaacctcagcatccaccaggcctgcctgaccacccgccctgttcctctgctgcagaaacaccaagtgccttggaaaaccacggctctgtttgggttcgccggctgccatctcccgtggaaagagccaggtgaatctgaaattagagccaagtatgccttgaggactttccagccaatctgatgctaagaaagatcctttgtccaggactggcccatagtggcaggctcggagacatttctttgaggctggggggacaaatccctagctatgtatgcagaaccatttatgttcatggtccacttgtgaggccggcgttgtgatctactttttcctaataaagatattgaggttcaaagagatgaaatgatgtgtgacagggcacacctacggggcttcagtcagaacccagtggcaccctaaagctgctcccagggtgaaagtcaccagtagcagtagacccttgaaagccatctggggatggctatagcccaaattatatccctgcaggcctaggagtgggggtcacttttctctgttgctaatctccaggggtctcgaattccctgttggaagtctccactcttccctcagtgaaaccaattccctgttttaaattcctcagcgcttttgaaccaaagtgtttgaaatccctagagtgatttctgttctcctgtgtggctcctggatgattcccagccctgtctaaactattgccctgccccaaaatcttatatgcccttccttgcttagcatgatcactgtccaacattctatatattttactgatttctctcatttattttctgtctccctcactaaaacaagaccaggaactggatgcagtggcagtagtagtagcagcagtcccagctacgtgggaagctgaggtgggaggaccacttaagcccagggatctaagacaagctcagggaacatagtgaagccctgtctcaaaaaaggcaagatgaggattttcccgttttgttcactgctatatccctagagccttaaacattcccccagcacacagaagatgttcaaaaagtatttgtcagataattaaatgcacaacatactggatactccattttggacccagactggaacgtgggtgcctcatgcaggttcccattgctgactcactccccagcccagctgcccttctgtctccatgctctggaactccatgcccaatgccagtcacccacctatagtctcctgacacacccagtccatgtgggagtgcagtcagggggactcaccggggataccagtgacctttaccaccctgccctggaggaagcacagaaagccagagagaagcaggacagaggaagccagtgaaaggcaagtcaagctgctgggctgttccagccctgaggggcttggtgtgtgcatgtgtatgcacattctcacacttgcacacaaacctagtgctatggtttggatgtgtgtgttcctccaaaatgtacatgttggaacataaatcccaaggcggtggtattcagagatgaggcctttggggaagtgatgaaattgtgagggttctgccctcatgaatgggatcagagcccttaggaaagaagctgcagagagctgcctggcccttctgtctcttctccgttgtgaagacaccaagagggtgctgtctttgaggaatgggtcctcaccagacaccgaatctgctggcatcttgatcctggacttcccagcctccagaactgtgagaaataagtttctattgtttataaattatccagttcaatgtattttgtttaagcagtggaaaaggactaagacacctacacacatgcatgtgcacacacacacacctacacatgtatgcacacatgcacacacccacacttatgtatgtacacctacacgcatgcatgcatacttatacatatgcgcatagctacatgtgtgcacctgcatacatgcacgtgtgggcacacatattgcacacatgcatgcacactcacacacgtgtgtgcacacatgtgtaccattcaacacatacacatgtgcacacataccatgggttgcatgtgaagaagatgaaggaaaagatctaaccccctctccacagtcctgtgacttactaagagctcttggaggcaggtaggaaaacctcttcctttttatagatttactgttctgactctgaagattaacatagatactctggcagggggtcatatagctgtggctggtgtacgtgtgcttgtgtagatgggggtgtgtttaggtgatatgtatgtgatatgtctgtttacatctgtggtatgtttgtgtgtatggtgtgcatatctatgtgggtaggggtgtgtgtttgtgtactatgtatggttgtcatgtgtgtccacgtgtgtctctgtgcttgtgtgcattcaatatgcgtgtttgtgtggtttgcatgtggtgtgtgtggcatgtgtatatgtgcttggtctaacacacagaagtacctgccactcataatgaaaataacaaagggtaccccactaggacagcccacccagatgaggacagaactgggcccccaaagcacccccaaattgtgcagtgaggactggagcattcaaggccgtcactgctgactaaagccaccaggggagctactccctcagactcagtctgggggaataaactccagggaaaggggatggggcctacagacagagtgggtgggggtgtctgaaaggtgggtggaaagtcacgcaggtaacctacaagaagatggctctctggaggagagggcaagcccacagaggcccacaagggacccagttcaaaggcacttctccagagcttctctccggaagtgggacagagtggcccttggtgaaccacctatgtaaccctcctctcataattcctctaaggagccctgccccacagcatagaaagtgggcaacgccacgcaggcctgctctagtggggaaggtgaggggagctggcaacagagaagtgaggcccactgcagcccccactccctgccagcacccaggccacagcatccctggaggggatggtgtccaggtggtgctgccccacacagatgaagggtgcccattgcaaagctgggaggggtagggaagaaggcagacccgtggataacttgggtggaaggactgtaggacccgaaatttggccgacatatgaagcctaggagtgcctcccaggggtcagtgagctgcaggggattgccagaagtgtcagacaaggtgacctcctcccccacctggcactggtctccttatgggcccagaacccccaccagcctcccctcctgagtggggcagcagctgagccaggacatccttgggggatgtgccaaacaattactttacttattgaatatctgattaattattcagaaggtgaatcaattattcatatctcatttaagcaagggggaaaagccactgccccttgaaagaagcttctcagcgcctcccaaggccctggggacggagtcatcagcgggagaaattgtcacagcaggaatgtgtcactggcgtggctgctgcaaccaccacgggcctcctcctgcacacaccgtcacttgtgcatgcacacacccgctcacacttccacacacacacacacagagcactcagatacataaaagggaagaagtgtggatcacacagaggaagagacagtccctcagtccatcagggaaggtccccagtaaaaatgacatttgagttacgacttgtcagaggaaaagacagagaaagtggggaagggtagtccaagcatagggaactgcaggagcaaaggtgcggaggcgtggaagagcaccaggcacccgagggcactgggatgggagagggatggtggcagggagcagagactggatgactcagagcctgggcttacccagtggggagccagtgagaatgtgggagtgcccctgtgggacactgtggctgaaatgggcttgtggggcctgggaccccactgggggaaagggggtcccattccagacactggtttacaacctcctcacctggctctgtccagggcgccctttggcaagaggccagagaccatctcagcaggctcatgaatcatgaggcttttgtaagtggcaggggcttcgccatttttccctccaagatttcccaatccaaggggaaggtgggctggggttcccccaaccaaggagcaagacttactgaccacgttttacggatggagaaactgagatccagagagaggaacgggctgagcctcagtcactcagacccaggaccagaactcaggcctgcagcccccaggcttagcagtacaatgcaggctgagagggtctgtgactgccagccccacctcaatccaggccctccctgagccctcagatggaggccctgcgcaggtacctctgcaggaaggtctgagcagggtaaggtgttgcccactcccactctgtctgtccctttaccactcttcttctctgtctttacctctctctttgtcccttgctcatttacttgctctgtgtgtttatggcagagagggtggggtgggggttgactttctctctctccactctgtctctgcttctcccatcttactgtgtcttcgtctctctcctactttctgtctctctctttctcactctcttttttctttctctctttccctttcctctctctctctctctctctctcattcttggtctctctgttacccatctttgcctttctgtctttctttttctccctcacattctctatttgtctctttccctgtctccctcccttttctctcctcccgctttcctctttctctttctttctgtccatcccaaggctggtccagggctgggatgcagcctcttccttcccccagcccttcagcctgaccagacccaggcaccccacacccactaatcaaatctgcgacctgattcaattacacccagcaaaaatgcagacgtgtaaccttgttaatatcacatttattagagggaggggaggagaaaattaagatagacttcgtgttgctgctaattagaaaaattgagactttacatctgcgtagcgctgagcaacatgtggtggtaacagatgtgggctcattacacagctgcacggggcggggatgggggcggcagggtgggggtgttgtgtggaaaacattcccaagccagcagcattctcgagctgtagccccctccacccagcgacccaggcctgattgacacccttaggaaaggccaggacccaggagaggaagcgtgtgggacagcagctgagagctctgccctggggtcaaaccctaactctagcatagattagctgtgtgacttggcccagcccttaacctctctgtgccttggtgtcctcatttacaaaatgatactatggaccccagcctcatggggctgcagtgtgggaggatgaaatggaacaaagcaagtcacgtgctgagcacagggtttgcacatgcccaattcaaatcatgggtccctgaggccagctgcagtgtggagggccagctgtgctatcacagtcattgtccagcccccactcatgaacctcaccaccctaaccctaacaaaggccaataggagccatggctcagcccctcatcccctgggggcttcatgggtctgaaacagccccatctcagagctcttcaagcttggatcctggatttcacttacaggggaaccacgaaggaacaacaagatgcagtaaaacccctacttctgggggcccgtggagggaggaggtggaggctggagatggcactggacagggttgccggataaagaaaaaaaggaaaaaaaaatacagggtgtccagttaaatttgtatttcagataaatagcaaattactgtttagtgtatgttccatgcaatctttgagacatacttatgctaaacaatgattcatctgaaatccaaattaattgggcattatatattttctctagcaaacctaagtggaatgtctgtacacgctggagctgggagagtacacagggctcccttgaaccccctggacatgggcaaccagccatggatgggctggagagaggactagtaatctctccctccttgtgccagccctaggagctcagcccaggcccactccctaccccacaaaccctccatcagagccaagtggaaaaggactctggcccagctcgctgcacccccagatcccttcagattgttggttcctgggactgggaggagcccagcttccacctgcaggccagcgtggcaatcagagccatgacagaggaagcgtggaagttcatgaaatgttgcctccttgtccccctctgcctctccccacctctatggcaaactcttctggccttgagtcccttaatggagcatccctaaaggcagctaggagcacaggccccacagagcccctttggggctcaccatcctatatatctgcaggcctacacagaagggacccacaaaagcaaaggatgatccgttccatgaactatgaaaacttcagtgctgaggggtctcaggggaagacaaaagctgccccctacttccccccaggcagggctttccaggcctcccagcctctggttccagattagtcatagccaaagggcatgagacgtgaagccaggggagtcaagcgaatgccgtggctgaagccagacggtgatgtcaggccagggtagggaggctcagggtgggcttcccctggatgtgtctgtgaggtggtgggcaggggctgcttaggcaaaagtctcccaaggggggccacaccacagtcagcccaaactagtcctccacagacacaaactgaagagcctgggacctctccataggggagccctgtcctgggcccaggaggggctgctgaagtttatttactatgtcttgtaccccgcagagtctagcacaggatttcatttggcaagcacttattacatgctgagcactgttttaaggatttgacaaatatccactcattcgttttcctaacaactgctggtggctctcctcttgccccactcccatcctgcacccagctctagtttctgaccttctctgccgtgttccatgttctgtgcaagggaagctgacctctacctgctgcatcaccccccactccctcacccccagctgtagtttgggttctgggagcccaccagttgtgactctagccatgactgcatttctctgtggctgcatatctgaatggggcatggaggaggggttccaagactccactctcataggcctcctgaaacaacctttccttcccttgccccttcagtctggcaggaggagggggtcatcgttttctgctcttgctaaccgaggtatgcctcaccatccctttctgtttccttaatttgccttaatttgaaaattgtccctttataatgttctttttagagaaatccttttggatgtgccatttgtttcctgccaaaatcctgactgatctaagaatcctatgagagaggttaccattatcacccccattgagaagatgagaaactcagacacaaagagttcagtaactcacccaagagcacaccaagaggtgaccactcctggtcacctaaagcccagtttcttctccccacactcccttggaaccctcttcacacaggctttgtccctagactccttgggtccctgtctcactccaaagggctgggcttccagctgtcaggttcagaccttatcggatcattgaataaatgagagcccaatccctggagcaggaaaggcttggaagataagatgccactaccttatggagctaggatagtgcaggcccatgcccccagcctcagaatgaggatcataatgcctatgaccaagctggagtctaagagagtcttgtgaaaggcctggccagccacatggtgattcttaaccattattttaaatcagtagttctcaactagggcagttttgctccctggaagacatttggcaaggtctagagacattttttattatcaaaactggggagagaagatgctactggcatctaatggatagaggccaaggatgctgctaaacatcctaccatgtacaggacagtcctccacaaggaattatcccacctgaaacgccaacagtgccaagattgagaaacttaggttacagaatctcaggactcatagagaacatttgttctattacatctattatagatgaagatactgaggacccaagaaggcctcaaagtcactgccaggttagaaatagccagtatccaagtccaagtccatatttacctccagagtctggtacagcacagagcaggtgcttggcttgacccagcatctggctgcttctagaaggtcctcagcttgtcatcagctgcctcccccaaccaggacaaggtgagatctggatgtgggtcctagggactttcttcccctggaagatctgaatgagtccagagagctttccttcggtaacctctcccctcccttcaagagctcttatcaagagcacacacactttcaggcatagcctgagctgtggctacttggttaatagccacaagctcatccataggccagttggcctcaaagggatccccttgcaaagccctgaatttattctgacagtgctgccagtggccttcggagttttacaggaggccttgtcaagggcaaacattgatcctttgagaggtgatgtgcctttggaaacagcttctggcatctagtatggtaagctcaatggagtacagactagatcagtccttctcagaaaagttctaagaaggagccatatatggaggtgaaggttttgtgaagtggttttggaggagctgatagggacctagggtcacctctggctgggaccacaggcacaagatcccatgctagggatagggccagagaaccaagagtggaatggggactcagataagcagagcctttactcattggccagaagcagagtgtgccaaagaccagcccccaaaccacccactcaatggaaaggagaggccagatatctgtggctcagcctgtggccaagagtaaggcgagaatctaaaggacagttgaacctttgggggccatccagcatccattctcctttctttgaataatgacatcaaaggattgcctttcagggaagtgtgtaagaagtgaaatcaaaggccaagaagtctttaatgaagggactacttgcagaggtgcagacagtgttaaggaaacaaacactggcccaaaactagccctagtggcaagaagttaccacctgtattagtccattttcatactgctatgaagaaatgcccaagacaatcatggcagaaggcaaaagaggagcaaaggcacatcttacatggtggcaggaaagagagcatgtacagggaaaccacccttttataaaaccatcagatcttgtgagacttattcactatcaagagaacagcaagggaaaaacccacccccatgattcaattacctcccaccaggtacttcccatgatacatagaaattacaggagcttcaattcaagatgagatttgaatgggacacagccaaaccatagcaccaaccttaggtctgaagggagaaatgcgactatggagagagcctgtccagcgggacacagagtcagatggggtcaatgactctagaactagtgtaacaccaagcaggaagggagtagggaatagagatcccatcctctctcctcttccaccctctgatctcctgccaatacctcccattggccaaactcaatgggaagccacagggcaagtccaagggtgagtcttttggggtacagagaatggcagagaaacaaactaggaagaaggggaggaaaaatgaagaatgagcagcacatctgtcctctttgactgacagatgggcagtaatcctaaatgaggctaattagaccttgctcctccatgatttttaatcccagccaataagacagaagaacagtggggtgggaggtgggaaataatcaatttattcccatagcagtgcccacactacagtccacagactgggtatggtgaaaggatgccagccaaaaactctcatcctgtcctatccattctccaccttcagtaccaagtggagcttgccatgagtgagagatgtcttggagcagctcccagtgatggctttataacagggctgcttggacaccttaaatcacactaatgaaccatgagaaccccctgcatggggtgctggcaggagaccacaccattgcaatggcaagaggggagacctttttattaggtttccccagaaactactcgataaatgcttttagcatcttttttaaataaaaaagaaatgaaatgtaaggggcatattagcgctgctcccattttcaattagtccaaatgatcatgttaaaagctattaataaaccaccgcaagtggaggtcactggtggaggagttcatcagggaggaattggcagcccacaatggagtcttacgcactgctgaggtctctcctcacccactttgcctcaaaagcctctgccatgagacccactacattcccacgatgtagggaaaggcagaaccacagactggaaaaatctgctaagatctgagcaccatgcctgctcaggtctgcaaagacacaagaccctggttggaagttaaataattggctgattctatcagttttatcaggctcaggtcatcctttgtggtcctacacagtctgtgctgaaaaggatcctagggattttgcccctcatggggaaatgtggcttgattgattagtgatgtctgccagggcaatgacttagaaggtggtggcatgcttgtcctgtatccaccatgcctgcctaaacctggtaggagaggaactcccagcaaatggacaaatggactccctttggtccatttgctgtccaaaggccagcccccaaaccacccactcaatggaaaggagaggacagattccaactatgctcaagtgagccaaactcttcctacctgcctcctttcgtccagagccttgcttctgggcagatagggcccacgggacagggacctggattcaacatttcttctcaaagcacatctgagcacaaagactcagttttattgttcccagctatgccagaactaagataagggatgggatctttttatcctttgtctcagagactttcaggccaggattggtactaacgttctctggtctccactggtatcacagtctgagccccgtcttccctgactcaggcaagggctctccatgtttccttgtctcagaatggtctccacagagcacagccctggccctgagcctctcctgctcctgctgaagacctcccatggttctccagtgtctccacataaagttcccctcccagcctcacctctagtctctccccatgttcaccacgccttccagtcactgcactccctgtgttctctgacagtggtgtgcgtggagacacctccaagcccttcacttggaacaaccctgtcccctccaccccgacagctaactcctgcttatccttgaaggtccaactcaagagatgacctgctcccccatgaccactgtgatcccctaagtcggcacaagctgctatctgggcttccaaagccccttgtacctggatcctcattgtccatttgcagatcttccccacatgactgtggtgaacgacacagaccacaccatctgacacaaaaagggcagtaaattcccccactggatcccagaggcaaggcctacaccgaccctcaccccctgtctcccacacccacccagctggggacccaacaagaagggacaccaaagggaccctaatggttcaaagggaggtttcagaggtctccctaactgggaccacaggggcattttacctgttgtcctttggctacacccctaaaaaggaagaagtcacccctgtggtctggactcaagctccacagtccccacaccctcttctccatcactcactctacttgtcagaacagaaagctgattccaaagctgagagaagagctgcccatgggccagagcctggggactaagatggaagtagatggccaagcagtgtggcccccaagaaggacccagcctgagatggacaagagccccattcctggttcctaacaactcccactcccaccccatgattgatggtgagcagatgcatcctgccccctcccctctcctcctgtggaggtttttttgttaggttttgctaaagcaacctgcaaattaatttaatatcctcctttggttgggagctatgaagctgggctcgaggctgatgatgcatgaaccatcggtggcaagtatttaatctctggacaatggatagagatgttagtgcatgccacactaaattctatttacgctgcctattaaaggcagtcaagctgaagggaatcggtgcacattacaggccctaatgggagaggaagctccacaacagtacattaaaggcggaaaatgaattaggaggggactgtggaggagaaagcaggcaggccgaggggcggcctggatataactcttcctgacagcctagcacacatgcccagccccactgttcagatttgctgagaagagaggctccagtggccctcccaaagaccttgactgtgggtaccacccaacctacatgggagttcctgtcctgcaggtgaagaaagaaaaggggttggaatgatctcaggctaccaagccagcctccttgcactctctaggtgggtccatctgaaggcctggggcattcttcatctccacaggctcaccagtacttctggtccttctacaggcaggaggaagctggcaatgaccagagggagtgggtctgtgtgctgttgctgctatcacattattgggcagaccttgggaacagtggttacagtacaggggattacggctacagagactttgggcaagccatgtaatctctttaagccccaacttcttccactgaagagccataataacgtatacttattaataatgtgtcacgagggcttaagtctccctgggtttacacagatcctaagtcctcctcttttctgtctttctcccctacagtgtcttgtcccttcagagcccagcatatggctgtgcacagagagggcatcgtcccatgcttgcttgttaaagagagcatttgcctaaggtcacccagcaggtaagcatctcaaccagcattagcaccagatccatctgactctcatcacacctccctccccaacacccttctcctaagcaggtgattcctggggtagttgggaaaatctgagcaaatgttttgccttcaaagccagacggcagagtctggggtctgcagggggtccccagcttcctgcttcctgcaaagtagagtgtggagcacaattaagcagccatagatgtgggacttcagaaagaagtgatgccagtcagaggatggtattgctgggctatacaattgggaaggggaatcaggacaagatggcacaagcttcatctagcagggtgaaatgttaacagagtaccctcgtaggaaggtgtccatggtcacccaagccctgcacccccagcacctgcaaaatctcaagaaggacctggggtactgggaagaggactaatggcagccttggggaactacccaaactaccagaaatggatgtctaagttgttgccttcagaacaagtcccagctccttaaatcatctgtgggccttaccgtcaggcctgccacatgtctcacccctctattacttgactctatgtgccaataatactgaacaactcagagcttccagaatacaatctgccatttcacatcttgcctcttcattcactgtttcctctatttgaaacactttaccccacatctcctggcctattcctagttgtccactaggactccactatctcctctaagtcttccatgaaccccaggggcccaccgtgtattctgctacagtaccttgtactacctccatcatagcacttagtgtattatgtgattaaagtcaaggtacatctccctggttcattctatgtttccagctcctaacatgagacaggcacttggtaaggcccagtgaatatttgttgaactgaaaggaaacgaccatttgttctggtcacccattctgagcagatgtactatagcccttgtcattaatttatacaacaccataaccagacataaaagcttcaggttatgtaggctattccataccactgtcactaagtagctgtacatgccatgaaatgaaaggattacatatttgccatgcttattgtgatggtgaagccaaagcagtactcagaggaaaatttgtattcttgaaagcatccattgaagaacaagaaggactaaaaataaatatctcaaaggaagtctgggtaagcatgatggactgaaaatatatatccagcttccaaaattttgtcgctattgcctttcctattctcctcgtctttgtggcttatgccctttaaaaaaatccctttgctgttgtttcactggaagtttggggaggaattagcacacctgacatggctatgcagaaaccacaagaacgtgcctttcagatctccaacttcagtgtaattgatcaactgccccaggtgctatgctctgactccaccaccgcattcactcccagcctctggctgagcacagctgagatagtaaggcaggtccgttgtcgggagacatgagaatcctttgacagatgattttagctggagactgcctcatcagctttgctgaaactttcttggaacagcgcagcattctaatagttttttctacccaatcttcctcccttccctctctcctccaaaatgttagacatgcatcatagtctgacagctctcccagcctcctccagctttctccccatttttccttcacaagtgtttttcccaataaagcttttgtgcatttaattccacgttggtgtctacttcttgaagggcccaaactgacacatatgaaataaccggatcctaacccagcagtgggagagctgagaaacaacttgattcactggaatttctgaaaggcttaggaattagaggcatccgggagcactacaaatagggagtgggagacattctcaaagaaggagaatctatcaacagtttagaaaagtacctggcacacagtagtggttatataaatgtttgatgcataaatataaacaaaattggtgtaaaatgtgtttaaaagcagtcagatcactagatgttctccccaactctttcacagggaagcaattgcccctccctcctctcagcagatgggtggagaatttttctccagggagtttaaggcaaaggaccaggcactgttgagagcagggttccttatggaacatggaatcaagtgaacattcacgcattaaatgttgacatctccccgtgattttctctcagtcaattctcaaagcattgacagccaaaattttacctacaagcaggagactaaaataatcttatctaagaatccaaccaacctaaagagattttaaaattatgacctcagacaatgctccacaggcattggtcaccctgtggggaagctcagagtcagcaagccccacccatgacagtcagctggtttatccttcctttttcaatcagaacaaacttccaaggattaacagacatctgaggaaggcccctgacccggaagatcaaaggaaatgactgcagggcagggagcaactaggaaaaacagaactatgctatttaagaaatgaagaaatgtcattccatgcatatgaaatgtctagaacagacaaagataggaagaagattggtggttgcctaggcagggtggagaggaggaaattgaggagtgacagctaaagggtacaaaattcctttttggggtgacaaaaatattccaaattgattgtggtgatgattatacaactctgtgattatactaaaaaccattgaactgcatacttacatgggtaaattccatgttgtatgaagtatatctcaataaagctgttacatatgtatatgcaaacgcacatatcttcagagagataacaaaagagatttcatgaaataaatgtaaaataatataaaaaagaacattcagcacacataaaaagatgccttagaaattctgaatgcagcagagtttaaataaaaactcaaaagaaggatccaaatataaatatactctccagaagacagagaaaaaagacaaagatgtggaaatagaaaaggaatgatgagaaaattagagaatcagtcaaagatgaccagcatccaaatgatgggagttctagaagagagagcagagacaatggaaggagaaagtcaccaaaattactcaagacaacttcccagaactgaagaatataaatttccaatgaaaaggtttgatagagaggatgaacatgttctgacactaggcatattataatgaaatgttaggaaaatgtgcaaaccctggatacaaagggaagatcctgcaagcttctagagaaaaatacaaaacaaaagagatcgaataaagagtcgaaaatcagaaatgcttcagacttctcaactagaagacaatggcacagtaggtattggttatctattgccacataacaaattaacctgaaacttagcagcttaaagtaatttttttaagaatgtatctcatacagtttctttggttctggctcagagtcttccttaaggttataattgaaatgtcagccagagttgcagccatcgaaggcttgactgggcctgatgaatccatttccaagttgcctcactcacacggccagcaagttgatattggctgtggctggatacctcagtttctcaccatgtgaacctctccaaaaggctgccaagtgtcctcatgacatggcagcaggcttctctgagaaacagtaatcctaggaaaacaagccatagtgtcagaagccacaatgtcttttgtggccattatttctacactattccattgataacccaggtcatgcctattaaatgcaggaggggactctatagggcatgaatatcagagaagagaagtattgggggctattttggaagctggttaccaaataatggctttgaaattatgaagaaaaatgaattctaaacaaaaaaagaatctactgcaagccaaatattcatcaagtgtgagaataagatagggatatttcagacatgagaagtctttaaatattttacctctcaggtacctcctcttaagacacaattacagaaggtgctccaccaaaatgagtttgtaaaacaagaaagaggaagatgagattcagaaaataagaaatataactcaggagtgaaggacagagaatttccggtgggataggggaaggaggccccaggtcaacagctgtgcgttaggcttagaaggcaaccaggccagattggagcaagccacagccactgggagggacttattcagaagaagagattgacagaatatctgatgtgtttgagtgcctggataggtgaattaggcaacaagcaagaagtttggggttaaactaatgattaacaatagcaaagcaagcttcaaaaaccaaacagacaaatactagcttcaaggaaattaaaagttgcatgggaaaagaaaagtaataatagtttactaccttgctcagctgtgaagagtgtttacacagcaataacaatataagtgttaagaattggtcttagcaaattacaatataaaattatgatacaactatactgggaggatggggtaagtgagaaggatgtagaagtgtggtaggacaggtaaaggaaagaaagctaaatcctcatcttccatggtgggaaatcaagatgtaatacctagacttgaagaaacaataagtactattgcaaacatgttttgttgaaacacagaggtaaatatcaaaatctgccaaaggtggggaaggtggttgcctctagggaaggtgaaatgtgggagaaattgctggaggggtttgtaacaaatcctgtggaacttctgaccctttaagtgcatataaaacttgaacaaaaaaaagcaaaactgaagagaaaactgaaatttccttcagaaaatgataataaactatattagaaaaaattgacaaaaataaaatttgtttgtaggcatgttctctccttataacatcctcctcaatacttcttcattttctcattttctcctccatcaaccaggctttggagtaagatagactgagattcatagtatgtcttagctgctaactagctgtgtattcatggttttggacaattctactctcttagttttagttactttatatagtaatataaggagagagaaagagagagagagactgcaaatgtctacctagaaagaatcaaatgaggtaacatttatgaaagtgcccagcatacaatatgttctcagtaaatactagcttccattctttttttaatgtagttgagagaaatgatgatgatgataatggtaatgatgatggggttggagatggggtgggatgataatgatactaagctaaaatttttgccatattatcgcatttaatcctacagaaaccctgtgaagcagaggctattattacacccattttatagatgaagacacagaggcataaggaggttaagtgagccatccaaggacataaagcccgtcacagaactgagattgaacccaaacaaacttcagattcaaggatataatcacttttaaatactgccagctttgctgtagtacaatatcttaggtatattttgctgttgatgttggcacctccagaagacaagtggccacgagggtaataactaaatgactggatggacaataaactggtgaaacaagtaaacagatcagtagagatcgtgctccactctagttatggtgcatcccagcaaccaaccctctatggactaaattgtgtacccctttccccccagaattcgtatgtcgaatccctaacccccaaagtggctatattggagatagggcctttggaaggtaattaaggttaaatgaggtcataagaatagagccctgacctgacaggattattgtccatataagaagagataccagagagctggttctgtctctctctgagtgtgcacaccaagaaaaggccaggtgagcacatggcaagaagtctgcaagccaggaagagagccctcaccagaacccaatgactccaatctcagacttccagactctaggactgtgagaaaataaatttttgttgtttaaactacccagcctatggtattctgttatggcagcccaagctgactaatacacagccaacatttttattgagctgattcaaagcaaatggccaccgaaggggcaatgtggtacaatggaaagaataacaaactccatggggagatattcaggttccaatcctggttttgagacttacgagtcgtgtggtctgataaaaatctcctggtgtgtctggaccatcattgcctctataaaaaaggaaatcctagagattaaagacacctggagtcatctacttccacatgttaaatacgaggaagcagcgataacgttaacatgcactgagagttccttctgtgcacttcacatacaaattctcacttaatgctcaccaaggtggtatgagatagccactatcataatccccatttcatagatgaggaactgaagccccaaaagagattaaataacttgactagggccatataatgagttagtggaagggaaggaattaattaaaatcacaatataagggtgccaaagtaagaaattaagactgcaatactacaggtcatatgtaggtgctctcaatgacagttccatgagagcccagccatcagccatcccagcccaggaactggaccgcagagtgcagaagccatcttgggagtactaatagattccccagcccctgccattctagttatcccagctgaggccccagagagcacagagtagagaaaagccatccttgctatgcccgttcctaatgcctaacccacaaaatctgtgtgcagaataaaatggttgttgttttacaccagtaagtatttgggtaggacacagcaatagcagccagaacagcatcccaggaaaaggggtcagcccagaccaaaaggaagtgtgccagatcctcccaggtctacctagctatagggatctcatcagtctgccatttgaagtcactttgtaaactgcaacatcacggccacagaaatgcgacaggctgtggcatcctgggctatacttctttcctcatcagagggaagcaagctgcctcaagggaagccagtactctcctggaaaccagctcaaagaactgaatttaggctccctttgatgtagacaaccctagagcatctctcaaggggtggcccaggtgagggcagcaggcatcccaaaatcaagctatggggagaagcgagggaggcacagcagctcaccttggcatgccatccctggttcctaggtctaggataaccctcacatggttcctccccactcctgccccccatcccagcctgtccctgaatcattagtgctgattttgtcgcctcatgcctccacctgactcccctcactctgctgaggaattgatgttctagaggtgcccttatgatttgcacccagtcatccccatgcccatttctctcaagacaccactccaaacctccacctctctgaagtccttccttacagccctcctcacccttgctctggggaaacaatcactttgcattttgcactccactgtactctgtccatcatagcacctcgttaatgcaattcaacaaacatatattaagcatcaactatatggcaggcacagtgctgggcactgggagcatagaaatgagtcagacagtcatgatccctgtccctgtagggagtctcacaataaacacattattacacacagtaatgtgggcacttggacgcaggtaggtcctccatgcagtcagcctaacgcaacctaatgcagcccaacacagatctgcaagggcctgggtcctctattgccctggcgaagggacttctgcaatctacacatggggagtcaaccaagcaaaggcattggaagatagatgatagggagcatagaatgtgatcctggtagaagggacatcttgttcaaagacctgaaggtttaaaaaaaaatgtgtttggttataaaaaaattaaatgaagaagaaaattggtcccaaagggtgcaattgagagtggtaagagatggggccacaggagtcagtagggtcttacagaccttggaaaggatgtttgcctttatctaaaggaaagtaaaagcccccagagaattttaagcacaggagtgacttggtcagatgtacactatagaaagaccatgcgaggtgctgtgtggagaaagaattgtagggccaagaaaggcagcaaggagatctgccgattggtttttgagttcttcctggggagagtaggtgggggtggagcagggctgctggaggaaatggagcaacatgggcaaagtcaagaggtagaaggcttgggagacaaattatctaggctttaaagatggaagagatgatggaagtgaggtctagaggaggtgaagtcaaggaagatgaaaaacagtgatggaagtttccagattggccctatgggagcatggggattatgttccagaaactcccttcaattcacttataggcattatctcttcaccagcctgggatattcccatgggcagggcctggcctagagagacagcaaagggacaaagggatgaggaagaaaagaatgcacccacggtgaggtccctgcctttgaacaccccttcttccctctcagccttcccaccatccatccgtggcctattccttcaaggacagcctctgtcgcagctgccagcagctcccatccaccagctgcagccccactgctgaaaattaagctgtagtgtttacaggacttaattagcaaaatcactcatcatcccgggagctcactgactacccagacatgacaccatttgaaataaattagcccagtgcccattgaggtcaccctcattccagtctggggtcctagcttgcccaagaccccctgacccacctctggggcctcccctgcacctccagatcccaggagcccttgcaattaatagctaattaacaaacaaaacaaacctaccaggtggaacagcagaaagacattctcagcccacaaaagcaagtaattattcggtgtgggcaggtctggaaaaaaatcacttatgagataaatcaatggctctcccccatcttgagggcctgttaggatgaaggaaggctcctcaagatcagaaaattgatttaaaggaaaaattaagcttggtccatttcccctacagctaatcacaaacgaagacattcctaaatattcatttttccaggcttgctgtagtcgcattggagatggaggtaaattgttcacttaaaaaatatttattgtgcacccaccacaaatcaagggatagagaactgggcaagacagtcatgactcctgcttccttgggtctttatattctaggggtttgaagacagacaatacacaagaaaacaaacaagatatttcagatcatgattagggctatgaagacaacaaacagggtaatgtgaggaggaggagtgggctaagggctgctttacaggtagcatgatcagggaaggttctctgaagagatgacatttaaactgagccagtcatgctaagaactggggaaagaatgtgcatggcagggggaatggctggtgcaaagaccctaaggtggaaagatgccaacagtccaaggaacagagaccagtgtaactggagcatagacaatgaagaggaaagtaggaagtaggaaacttggagagcagacagaaatgggatctggttggccttataggccaccagaaatattatgtttttattctaagtgaactgggaaactgttggagggggttaatcaagagtgacaggatacaaatgtaagtggaggggcagtgggtgctcagggcctttcgcatccctccaagtgaacccctgccccaccctggaagtccttgcatgcctcaggtaccagcctttgggaatgatggcagagcactcatttccaaaatgcatcactcttacttagctactcaaactttacagattcaacagatggagaaactgagacacaatcactaagtgagtacccatccagtatgagccaggattttacacacataatcttgcagaaacctcacaacagcccagtgaggcggtagtagtatcccaatttaacacatgaggcaactgaggaacagggaagttaagtgatttgcctaagatcccacagttggcaagtaccagagtggggattcaaacatgggcagtctgaacccagagtcaagctcttgccactacaccttacagtatccacagtgtaagttttttccctgagatttcacagcccactcaggcctggaactcaactctcctatggtcacttgcacacacctgtttgagatgaggttcccgagtgtcaggcagtccccgctgaaggatatcaggtggctgtcatagagctaaataagcaacatatacaaagtccctaacacacagtgcccagtgtgatgtctagcacttagcaggaactcaatagattttttttttaagaaaatgaacacttctatttatgttaaggtgaaattccattggctttgaagtgaggtgtgcaggggatggtaaggaagaaggaagccattcccctctggggatcggcagaacacacctactttacaaaacagaccttattttaataaaatttttaaagaaattatttgacttatttttaaacaaatatgttaattttatctgaaagtgggtcagatgaaaaataattaaaaacaaaacaaaaaaaactttaaacaggggttcttgtactatcttagaactccagtgggtcaagcaccatggtgcagtcaagtagctgccttctggagcctaccccagggcatctggagcagggccctgaacagagagctggtgtctgttccattcccatctaaaaggtgttgctggcccataagctttgagaggtggagaccatccattagggaggagagagagtggctttcccactaagctgaaagtgtcctggctgaaatcccaatggcttggtgagactcatgccaccaaagtggtcctctatggcccaaagtcagagtgaaagaagagagcccagacttccagggcttacatctgagaccagagcaaagtccaggcataagatggggcccatgtgcctggaccactgatttgcagaaaagcaggaatcttccctgcaacctggtaagatgaagaagtctgtttcgtcccctttgaaaagctcttaatcatgataggttctcagttaaattggcacatcccccacccttcctcttcccttcttacctcctcctccttctcttcaccccatctctgggctccactcccttccagaccttcccatcctgcccctccctcaatgtctccttaaaaggcctttcagggactgaaccagcagtgcctgagtcagtggcagacggcacaagaggccaccagcccgactcctctacctcgaggacactcggggactgtccccttatgcaaaacagcaggcgcctgaattcataattggacgttccaaaatgtaattatgaaagatgaaatgctcctctcaatgagaaagctgtaaatagaataattaattttctgtttgcttgaacaattctgtattatggatcttatagtggaactgaaattaattaagtgcaccaggatttatggaggaggtgaagagagagggaaaaaaggaattaatccggagtaaaagatagatgagtttggaagtgtaatgatgtgttagcctggggtattctttaacaaatttaccaggcacgttctgggtacaaaaggcatgcattgacagaattatctcaactaatacagcagctggtcaaaaattgagtaagagggaggtggacggattgggcctgtgaggtccctgaaggagctggagatgggggctaattttgagctggccaggagggggtcccaccaggaggagaaaggggcccaaccaagcagaagcttctatccccaccgcaaagcaggaaacagctgaaaggtactaggagttgcagagaggtaaaccgggagggccagaatgtgaggactaactgagggagaagctcctcagcactcctgagccccccgaccaggtatgttcattcctagcccagcaatactttcagccccatgcactcatccagtatttttccactactcttaaacctagatgggaagtgatatcacatgacttccagggccaggttgtgaaaggcaatgcttctacctgtgccattacaacccaaccaccatgctgtgaggaagcccaactagctcacacagagagaccctatgaaggagaactgacagccagcaccttctgccatacctgtgagtgattccagcccatcttccagtcttccaacagacatcatggagcagaggcaacctatccccactgtgccccatccaagttcctgattcacaaaactttgacagattataaatgagtgttgtgttttaggcccctacactttgggatgatttgttatgtagcaatatataaccagaacagggtccccacttaaccagagtggtgccctctttcatctgccctttatgtcagaatcccacatcagatttctttttttggaggaaggaggggtttgtggcttaaaaggtttgaaaacacactatcctcgtggggaaaaagtaataatacaggttgggagtcatatagaactgtgttgaatcccagctctgagcttcctggccctgtgaccttgcactgctcccaccacctctttgaacttccttctcttcacagataaaatagaggcaataacactgattgacggagttgttgggaggattttaggtacactgcgaaggtgattacttagcctgtgaagccagcaaactgtgcccagataagagtgaggctccagagtctgatgaacctgggttcaaattacagctctgtgttttcttgctgtgttatcatacacaactcacttctttggacctcagtcttgccatctgcgcaatggcaataataattgcacccagttcctagcatagtaaaggcaaagaagtgcacatagtgagtgctcaataaacaagagtttgattgatgctcacttcctctccaggagcccaaactcattaaactcccacaggcatcaaagcaactaccagtggttttcaaacgtctttctctgaacagccagacgtgtgtgcttagtggtgctctcatgaagcctgcacattccgaccctgtgtcagaggcagatgcatgggacagcagcgtggaagttctgggtagcaaatacctgtttctactctgacatctgtcctctgcaagcagtaaaatggcaaacaggaacttcagtgtgtctactccaagtgtgctccggtgctgtttgtcagatcacagcctcccaagctgcgtgatcccatacccaagccaaccaggcagagggagaccctgagctgagtttgcatctggattgcaccaaggctccaaaccacgaggcagttcctgacataccagcaccctggcccccaggtgctgagcatccctgatgcagactcccaccccccagggtggtattaagcaggcatttagatacctggcatggagaagggtgatggatggctttattaacccaccgaggtgaagccgccgacagtgaaggactcccctgtcagaggaagcattccttgcctgcaggccccctcaccagcttgcctgatagtctgagtccttgacagatgggcagctcctacgagaatgggagggcagtgtggggatgggacagtagccctccaaatgccatgcctccttccagaccctaccccataagactgactaccacaaagccacctagccctaaaggtcatgcctccaatcctcattgtctggattgtgtagttcagaaggcagcattcaccttgtattccatataaaagatgttccctggggctgcacagtgcagcagccctactggcatttctagatgacatccaccaccggcctctgtgctgtgctatgtattccacatgcactattccatcatcctctccccaaaatcttggaaaaaggtaaataatatcatgaatacccattttgtagaggaggaaactcaggctcagagaggtggaggattgactggcccaacctcacagagcaggagttgagggtcccctcaactcctcaagccccttccctgtcttagatgccatgcagaaaggaccctgcctagggtggcttccatggctcctttatcctcctctacactctggtcctcccatcatccccttctcacttttgtactgtcatggactgaactaggaaactctcttccatcagttatctgaggctgagaccaagaacgagagaggaaggttctgcccactcccacttctctaaagttcccggagagcccctccagcctccacaaccccttccatccctccatcgccctagactgaatctcctctgggctccctcagggcctgagagaactcacacctcccctccccggcctgcaccgctctcaccattgctgttgcctgggtctttttcacatttgtgtggactcctgcagcagctccaagtccccaccctaaactccacatacacgatgggagtggtccttctgtaaaatccaaactccactctgtccacacctcagatgccacaggggctctccgagccctcaacataaagcccaaacccctcaggtgtgccccagctcctgccctaacaaccccctgcattccagccatgcagacccttgggtggttcattgcacaaacctgggccactcagagccttccttccatggggaagaccctctttcctcatcatctggcacctctgctcacccttctccccactggctcctggcccccacccctgctccctatgtaagacccacagggctctctgaacttaggttcatcacactcctcaatgtgtgaggtcacttacccatgtcacctacttccccatttttctgtgagtcctacccacccaggcttatctcatagtagatgctcaattagctagagtccttatgaattagagctataattattgtttcaaataaagcttctgctgcagcagggtttgctctggagcaagctcggctggcctctaccctcccctccacatcatctcaacctaaagcctttccctccatgttccagccatgctggcctgtttttagtttcttggttctatccagttcattcccacctcagagctcagagagcacatgctctcagcctggaatgttctccatctctctttacttagctgattcctacttaccctgcatagctcaattgaaatgtcacatcctcagaaatgcctcccaccaccaccctttttaaatcacctgccttattatataggatcaggatatgctgtaatagatgaatcatgtcgcatccctgtgctttcccatgccttcccatccctttgccttatgactttgcagttcctctcattaaagaggtagagtctatttccctattgcaagctgatctttgttatccaaatcaccccttcacccagatcaaaggagagtagagaggagcattttttgcagtgttcggagatcttacattggatcaaaatgcacctcttctcactagtgtcccccacaaccacacccactcctttggctacagtttgaagtcctttgtacaaaccattctggaaatggaatagcccagtattgctttcctggcacctatacaaccaggcagggatcaacaaagaagaaagcaattccatttattccacttattcatgtatgtataaatatgctcaacaaatattttattgagtatctactaggtgccaagttccagggttacaatggtatgtggaaaagaaatgggacaccatgaagcttataacatagtggaaaaggcaggcaatgagcaaacaaggaaataaaagcaaaaaaatcagataacaaaagaaataaatttaagcaagatttttttaaaaagaagtgattgaacaggaaaaaaattccaggtaggctgcagagagaatagcaaatctacaactcactttggaagctctgtttggcagaatttttatctccataagccaaagagatagttgatttttcactcaacatatatttagagagcacctactgtgtgcctgactgctctaaatggcaatgttaaaacttaatgtccagtggcctcaagtgaggaaggaagaaaggaatataggaaaattagcatttttgaaggcttgctatgtgccagatatgagctgcacaattccatgcatgtttgttcactcgagcctcatagtactgcagggagttagtaactagagtaattcccatttttactgcagcccagggagtcatcaccacacatccaggaagtaatgcagctggaattgggacctgtgcaggtgtggttcttatccccatgtcacgctccttcctcaaccttttacaaactgaatcaaatcatccgaattaaaatcttttttattttactgggatatgagaacttaattccaagatgaatgatggacaataataatagaggcaattgctcttgagtccaaggaaccctccatgcccctctccatcacccagccaaaacctcctccatgcaacttccttcccctacaatatatagtcctcaggtatggtcaagtctagatgccttgccaagtggcccccatcaaggagccaaggcacatttttgtgttttgttttttggttttttgttttttggttttttgttttttcaagacagggtttcgctctgtcgcccaggctggagtgcagtggcatcatctcagctcactgtactctgcctcccaggctcaagtgatcctcctgcctcagctccccaagtagctgggactacaggcaagcaccaccaagcctggaaatttttttttttttttttttttttgtagagacaggatttcaccacattgcccaggctggtctcgaactcttgagctcaagtgatccacccacctcggcctcccaaagtgctagaattacaggcacaagccactgtgccctgcctcaaggcacactttctacacaacaccaccatgagtctttggggcagatattttttttcatgcaataatgtttgccataaggaaagcatgattaaaacatctttttacaaaatgcattaattcctagacaaagataaaaattccatttgacacaaatagattttccatggtgagttagccctgcattgagggtaatggatgggggagtggggggagtccagctcataaatcaacagggggatgggaagggggaaaggagttgatggaggggagaaagaggcactagtgaaatttcaacctgtgagagtgatgcccctctccattcccccagttcttaatgatctcatcaggggtccaagatcgattcccagccatgttcatctatccccttctgcattcattattttaatagcatccacataagaccacttgacatttgcatcagacaagcattaatgggaagtttgtttgggaagcttaggaattgaagagaagcaggcaccttggttgttggccaggtcagtctaaatggaacaaacttggagactggggaaatacgggaggtggaaaatgacaatcaatgattctgttcaaatcagaccaatgttactgagattccctttcatgttacagggcttcccagcccccagacctcttagtaaaccaatgaatataaaacttaggcatgtgagcctgaataaaaggatcctagatctttgagctgagtcaaaaagaccgtgattctaattcactctacagacatctcccaggtgtgcatctgagctaagtgctgtattaagcttgaggaatgcagtgtgaatgagactcaggcctgccctcaaggagttccagtctagataaataaagagcaatttcagctcagggcagcaaatgttgtgttataaataaacaggagagagagacatgctctggggctttcaagaggcagggatgcttgaggtgaaacttgaagataaataggaatttctcaagcccactgggtagatgcattttcctggcagagggaacagcacgtggaaaggcatggagcatgagatagcctgatgtgtttgggagttgaaagaacttggaagtcctggaggacacagaaccagcaaagaagtaggagagactaaagaagatggccagaacattgtgtgccaggcttcagaatgaggcttcatcctgcaggtcaaatagatggaagtggagagattcaaggaaggaagggaggcagttaggacactgtttcaacagtcctcccaggaggtgatgaggcctgagctagggtcgtggtctcaaggttagagagcaggtgtgaagtccagtggtattctggagggagatatgatggcagggcccgacctgggtgcagcactcctctgtcaccatgaggcatccagaggacaaggaaaaacagaaggaaggagggtctgaggaacaggatcaatgagcctgggcctgaaagctgggttgaaggaacaagggacttagtagatattttcgaagctccaaaaggctgttgtcttaagttgagtttccccaaaagcagaatctaagacaagaacttatatgcaagtagtttatttgggaggcgatccctgcagtgaggaatggagacagtcagagaaggatagagagccaacgcaaggtgagtgattgagctggttaccactgtgggaaattggagctcatttccacagaggactttctggagaattgtgataaggtactcagacttgtccctccaaagggtgggaggctgggcatctactcaggactcctgagggttgcccactagggatgttttctctcctacacttccagattgcacctggggaggggatcaggaagattccccaagctttagagcaagacctaaaaaaggagagctcagaaatacaggaagcatttaaaatgggaccttgtcagtgtacatgggagctcccctaccccaccatagatgcaactgaagcagaagtcagagatgggacaaaggtatgtgtcatgggacaccaatggcacctgttgcagctgtcctctggtagagggagcagacaaatcgggagtggacccagaagtagagacaagcctattcatcatcacaaccctggagaaggcagaggcagtgtcaaatcccattgtcataacacataacattatacaactaggcattcctgtaccactaatagcaaaaactataatttattgcatgtttattggctgccagttgcaggggtaagagtttgcatggattatctcatttaattctgaaacaatcttgtaagaaaagttctattatcacttccatgctatagaggaaaagaacaagggtaggatgaaatacattatttattcaaagtcctcagattaaacaggaaagaaggcaggattagaacgagttctccttaacctcaacccctgcctagtgctgctccttcagcactacttgtcccctcaatctacattggtgggacaactggcacaattaatataggtctataaattatagtgctgtataaatgcaaatttcttgattttgaaaattctactgtgattatggttatgtaaaagaatatccttgtttttagagaatgcatactgacatatttagaggcaaagtggcattatgtccacacttactgtcaaacagttcagaaaaaaatatatatgcacatacacatagataaaataaatgtggtactatgttaactttgaggaaatctgggtacagggtaaatagcaattattttaattatttttagaactttcctataaatctgacattgccaagttttcaagtttttaaaaattacctaatcttgctgggacttacctgtctcatttttcaaaagcagaataaaaacttccagtccattgcaaagagcaacaaagaaagggtcactactagcacaggaaatgcctctgaggtgcttagcaggaaagggccttggccctgaagggttttctaggtattttctcctgctcaagagcttgaattctcttggtagctgagacctgggaagcaatacctgacatctgtccctggagtggcaggaaacagagcttccagacatgcaacctctccctggacctgccaggtacagccaccaggagaatggagccttcagcccaccccttcctgctgtttcatacatgggcaatgcaacttttggaatcttgcctcctttgtatctcaaggctgcttttggcctcaaggttccctagacttgatttggaagaggataatgctgaaaattgagtggtgaaatgccaggggttgggaaaaggggcgggaggaagttattgctggagcacatcaggggtcaagatgtgggttccagccctggttccaccacttggacaattccttctgagtctcttggcctcattatccccatctgtgacaatacctatcttacagccttcctttactcactcactcacccaacagcatttactgaggaccctctgtgagctacacgctggatgagtccctgtggggagagcagtgaatgaaacaaatatggtccctccatcctggaacttaccacctagtgggagaagacaacaaaaacaagcagataagtaactgagagcattacagactgtggtaagtggtaagtgctgtggatgaaacaatggcagaagatgacaaagaataaggggtggtgatcgtacttggatgggtggtcagggaagacctctctgagaaggtgaaactttaccaagactgaaggctgagaggtgccagaggaaaggcattcttgagatcatcagcaatggtttgtaaatggtcatgagattagtgccttccctcttccttcctccttccttctcaccttcacccaatgcgggcagctactcaactgaggcaagagccattttgcctgaaaagtccacagccccctgggcaggttgggctgtccctccccaggggcatccttgccttctgtcccagcacacctcaaggccctgcacacacaggggctgtgccagaattcagagagaaaaatgaaaactccctttccagatggttgcaagatgctgccagtttccagtggtgatactggggaaggtgccaagaaaactgcctccattggtgtccctctcactccacagccggggaagcctctctgaaatgtacttcaaagggactgacaggagttatgggataaataccccagctccctgaccccccaaatggaataactttgagatatgttctccactctctcagaaggcccttgtgggactgagtctcagttgccctgctggctaacactttctgtattaactttcttcccttccccatcccacccctctggtctcctctactgtttcatgagatcacatcccaatccagaatcctgtctcaaaatttgcctagggggactccaacttaggatagtgcttgataactatttagtaatctaagtgggattgtaagctactaaacttgctgatccaaggctggatcaacccctcttttagttcattgttgtaccccaacttctcacacagagcctggaacagagaagatgttccataaacatttgttgaatgagaaattgacctcacagaactaggcaagtccccacaagggcagacatcagagccaacccttctcaggatagccctggggaatatttggcccctgggcttcagacacttggcctctgaaccaaggaggccccactaagaaggccagaaagggggcactgccggcaatcacggcagtgagatggatgggcaacacggggcttcctgggctgggtgcagcttccaccctgttctgctctgcagaggagcccggctctgctgggcacagctcaccatggcgagtatgcaaacaaccacagcacaggggccatttcagttagttcaggaaaggtacaagagcatgacaaatatatgtaatttgtaaattggccagtcttttgcaataatttagaggctctagttaggagcaatagaaaccccccaattactgatgtttaaggctggcactgttgctggctgaatatttcatgcataaatgaacttccactaggccacccgctgcttctgatgaggctcttgtgggctttattgcccggcgcccagcagggtcccgccaatgggccccatgacggatgatgcatcgttttgcagcttaaataatgcagtgtggaacaggctcagtgctggtgcactttatttacatatcaattgagtggccactctgaatatgaagaaatatgagaggggaagtggctggcactgaatatttcatggccatgagccccacaggaagcgaatgtccccagcccagagttaggtctggccatgtgtgtaagagagaactggcattaatagtccaggagacgaggcaagaataatcccccaagccaggaggggagccactaactggaattgatgagccccctatcatctggacacagcctgctggtgctttttcaagtcagcaaaatatctgcttcctgcctgtaccttctggttcccagaaacttctgcagagaagggagtttgttcaagccatcacacgctgactttccaagtcatgtggatggaacagaagttagtatgcagtggaaaacagcatagtccatcgagaaagggccccatcctttctgagaatttgctggaagatgaatcaggaatcccagcccagccccttctcccttcaaagggactgacaggagtcattcacttaataattattttctcactggatgaggtggctcatgcctgtaatcccagcattttggaaggctgaggccagaggatcctagcattttgggaggcttgaagccaggagttcaagcccattctaggcacacagcaagacctggccatctatacaataaaaatttttaaatgatctggcacagtggcgcatgcctgtagtttcagctacttgggaggctcaggaggaaggatagcttaagcccaggagttcaaggctacagtgagctaggattgtgccctgcactccagcctgggtgacacagtgagaccctgtctcaaaaaaaaaaaaattatcttctgatcctctgccatgtgctaggcttctagctaagtaatgaggatacaactatgaaaaagacacagcccccatcttcatataccttccagttgagtgagaaaaaaaaagaaaagaaaatggggaaccgtaatgattgggtgtactaggtgtttacgactgcttaacaaactaccccaaaacttagcagcttaaaacaatagacacagcctcaaacacagttcctgcgagtcaggaatttagaagcgatataactgcgtgatttttgcttgggaattctcataaggttgcagtcagtatatcggccagggctgctgtcttccaaaggctatactgagctgatggatcccactccaaagcagtttactcacatgtgtggaaagatgctgtgggttgttggcagaaggcctcagttcctcaccatactgacctctccatagagctgcttgagttccctcacaatatggcagctgacttttccaagcaaattatccaagagaaagaagtggaagcagcaatgtcttttatgacctacccacagaaggcacaatccatcacttcattcgcattttgtttgtcacatggataaacccaataaatataggagggcactacaaagcatgactacaggagcaggaatcattggggaccatcttggaggatgggtacacatgcggcaagtagaggtgtaaggaggggcagctggtctggtataagggaacctaggaaggcatccttgaggaaatgatatctgattagagatgaaaaaataaaactatctcagcaaagaggaagagggaagagtgttcagcagagggaacaacctgtgcaatggccctgagcttggtgcatgggaagccaggcaactaaaacacagggttccatttggctagagcttagaaggggctttgaataccaggcttcatcctgagggcactggggagcctttggagggtgaaaggagaagatagccctgtgggtgtggtgggcctcaagtctgttacatcccttcaatagtgggcgagtctgggtaggtttgagataatgctctggagagatgaaaacagaaccccaagtgagccctgggatatactgtactctagagaggattcagtttagggttagagttaagttaatgttagagtcagagctagagaactggagagaggtcaccagaggcagcagatctgtctcaaaggtcagccccccactcacttgctggcttatatgatcttgggcaaatcacttaccctccatgggtaacaatcagtgggcctccattttctcatctgtaaagtaagaataatagtagcaccagcctcataaggttgttgggggtgttgactgagaaaagacatctgacacatgtatccactcagtaaagtctagtgcagtgaatgaggcctccatctgtgtcaaagatcttctctccaggacctgggatcccttcacccccttcttactacaaaccttctcccctacttttcaacactacctgagattctgctcctgagggtcttactgcctccaccacattggaagccccaaggagtgggcaaagccagactcattccccgcttgtggatggaccatccctctgacagcgcagtgctaaacccggtgagttttctgactccaccattctcattcccatcatgctgtcattttcattcctagaaattattacaacttgtatattttatttagctagttgtgtactttataggttttgttgttgttgttttgtattgctttatattttcttcttgctctttttcccccagaatgaacactctatgaggtcaggaactgcctgccttctttacttctgtagctccagcaccagcacagcacttgacaataaaacccagcagataaaagcaaagagtctgggccaggcttcctgggtctgaatcccagagctggtgctatctaactgtagagagacaatttggacaacacagtgtctcagttttcccctctgtaaatggggccaataatagtagcgatcccatggctgggcgcagtggctcacacctgtaatcccagcactttgggaggccgagacaggtggatcacttgagttccagaccagctggccaacatggtgaaaccccatctctactaaaaatacaaaaattagccaggtgtggtggcaagcgcatgtaatcccagttactcgggaggctgaggcaggagaagcagtagaacctgcaaggcggaggttgcagtgagccaaaataacgccattgcactccggcttgggcaacaaaagtgaaattctgtctcaaaaaaaaaaaagtagcaatctcattaggaggattaaatggtactatgggtaaagcactcaagaacagtgctggaacataggaagtgctatataagggtttgttttatacgtagatataggtagatgtagctagagataaaatggtaggtgttcaagaaatatttgccaaattaatatgctaagtctaggaacgggacaaagtcctaactggggcagagcctcagatagggacaatgacactcccaagggtaagttccttgatctgaacagagaaaaacttggaaagcttggaagccagaggcagctgggaagggcagctgtaagcaaaggcctggtggggtggggcaggggccacaagagaccctccatggaacccccacctggaatagccagaccgagtactaacacacactgaacagctaaatcatacattattgatttgtcaaacgtatttgcatataaataagcatgatcattcatggaggcccgagcagtggcacctcccctcagtgccatgattacagatggatggccctagttagacacgaaccagggacgctgctacccctgccgcaaagtcagcggctgatttaaaactacatttattggagcatgtaagtgtgacagcctagtggtgagtttgggataattagtctaaaagacaagataaacgactcctaaaactggtattgtgacgaagatcccaccctacccccccgccacagccagctcagccctgatgccaaaaatacagccgaagataattaactaggaaatgttaacaggcaggattatgttccaattgcattttccagaggactttagaattttacacccaagttgattgtgttcccctccccctggtgattaggcaggagaggcggattcttagctagaagcagaggctgggtggggtgggcagacaggcccagacaaggtctctaaggccaggcaagcaggtggctccagtcagccttccccgagcctgaaccgagatggatctgctgggtgaagcacgttgacccgggtaaattatatctgccatgttaattcattccacgtgggagatcagccatgagctcagaggctggcatcggctgcctctgatggatcaagggacccagctgctcagacacaatgctagagacttgtcattgcgggggaaacacggcttgctaatgctttattttaattgtcctaaattacacttgaagatgcacagcccaggaggccagccagcaaatatcaaacgttaccttgaggatctgcttggcctagagaggaatctgcagtcctaggactggggcctcaccgctttgctgatacagaagagagagccactgccttttggtttcaccacctgcctccctgctcccaaggaaggggtagagaatgccctgagacctctgacgcatcctatccataggtttgagggttccttctctgagagttaagtctaatggacctagacagaaagaggggggtgggcctttggagtttgtttgaggcaatcaaagaagaatctaaaaggaaggcagcacagcagaggaagccatggcagaagatgtcctcgtcctaatccccaaaaccgtacatgacaaaggggactctgtagatatgattaaagatattgagatggggggagtgagtgagagtgattgcaatgtcattgcaaggtccttagaagagggccagggagagagatgaaaatgctattagtcagctggcattgaagatggcactgaaggtgcaggtgggctccagaagctggaaaaggcaagaaaacaaagggtgcagccctgccaacaccatgaaacaaatccaggaagacctattctgactgctgatctccagactgtaagattataaatttgcattgttttaagccacttagcaatttgtcacagcagcaataggaaactaacatggaatctcattgttctcagcctggcctcaccacatcctggctgtgtgactttgggtaagtggctgaacttctctcagccccaatttccacatctgtaaaatgaggattatagaagaacctaatttgtggggccattgtgaatattaaatgagctaatgcctggaaagtgctgagctcactgctcagcatatagcaagagctcagtaagtagcacttactgtcgtggctgtcgttgtcgttattgccccttgctgctctttctgagaccctgcagtgaggataaaattagtaagataatacacatcaccaaactaaaagtttctttattcatctagtatttattgatcgtcttctatatgaaaactattctatcaggtattaggaataaaatagtgaacaaaaagggacttagcccctgccttcatggagtttataatattgtaggggagatggaccttatcatataattatattatgaataaaatataatgttatatgttatatttatattgaataatctcccaaacaagtgctaagattgagagatgctaaataaatacatatggagagatgtgtctcatcagggaattcatggaaagcttcctggaggaaactgacctcaaaagtttgagtagagttagtgctttgagaagacaagggtgtgggaggaaggactctgcctacatgtctggagtcatgatccagcttctggggtatctgggaggagtttagtccaaatagaatgcctgcagatgcccacgatggcaagtcctgggaaggtagaatggccctcgccacaggcagtccaaatagaggtggcatgatcaagtgtggccttgagctgtataaggtgagtctatcccttaggtgctgaatccctgtgtgattccgaataccaggctggaaatatcacctcgtaccttgtatgtgggccctgaccgtgaatgcaggggtatattctgcccttcatcagtccaaagcaagacacatggcatagtctagttcaatggagcaggtaagtatacctctctcatggacatggaaaggagggagggaagaaggaaatattttcctgaccaccgtgtaatctatcacatgccttaaaattctgcctgggcatagtggagtactcctccctccttgggatagacgggaaggtctaaggaccactcctcattcatgcacaagattctaggcctcggacctccactctgtgtatctatcagcctttctgcataccacatcatttagataatgactcaggattagccagatcccaaatcccctggtcagtgcttgtttctaggtgtggatgttcaccacctaaaaacctaggcctaagctggactgccaggcacatagcagctatgcaagaatgatttgttgagtaaatgaatgaatgcatgaatgaatgaacaaatgcccagcccaccccttggacatcattcgttggtttatttgatgccttctatctatcagacctccatttctgctgtacacgcagcttgggcagagatattgtgacataatgtaaaacccacccaccccagacaatgactgtgcaagctccagaccctttctttctcggctttcacaacagtggccacggcgttggcagaaattccaaaacagcctacaaaatgtggatgtgggagaccatatccccagaatgttttgcaaaaagcaaatattgtgacaaacaattggaaacatggtacatttatctgcacttgcagtagctgctcatatgttcacattaaaacagttgaaaatgtataattaaaaatctgtttcaaaatgcaaagaacatgtaaaaatagtttatccattcacagattaaaaacaaaaacaaataagtgtgagtcatgaaaaaaaaaaagaaagaaagaaagaaaagaaagcaaactccaacaggatgcaggccccaatgaatggcggctgaaacaagtctcacagtatacatatgccccatcacccccagtacagaaaccaggggatctgagttgaacctgtatccttttcaatttgcataatttgatgctttagtttctctatgtgagaggagttgtgggaaagaatagtaagtgaatatcgggtaaaaagtcctctgcacagagctcaagacctagatgaggcacacggatccaaccttctagcagtagatacagacaagcatcatggggaaagcagatattaaattaaaagcatttttacaacatctccacctcccagactgctaaaattaggcttatctttggcaattctgattctctttctctcttgccatcagagggaggttctgagtctgcctgtaatttccctggcattttttttttttacttacatttgggaaggaaggaaacaccacttaagagaaaaagaaggacttgagagagaaaggggagtaactagaaagccaagagccatgagtggtttggccttgagagaattttagttgggagttaattataagagaaacaaagagaagcctctaggcagctatggagggaaggagaagttaaaatccagagaaatgaggaaagaaaatcttaatgttactgtgaattatgatttggatcttctttgacattctttaagagataccaataaaagatttaaattgctctaaattcctttgattgctgtatgtgattctttgaatatgacaccatgctggcactggaccacatggggccttggttttatttgggttacatgagtaaatatgcatttaatctaccctgtgaaacacgctctgacagaggtgtggacacagtgctttgagaatatgagaataagggagtcccagaagagaaaagaaggtttcccagaggaagtcatgtttgagttgaatgcaaaggaatatgttcaccttataggcatgaattgcaagggcatttctggtagaagaaataatatctgcaaagaaacagagtattcgggagaaagtgaaaagtctagtggggtgaagaagaaaccagaaagctctgtgggtagacaggagctgtatggtgaaagggctcaaatgccattagcagaatggcctttattctgtaatccacaggcctttattctgtagtcatggttttgagtgtggacgtgacatgttagaggttttacattcatttaacactcttgccagagacactggacccctaaagcagcctgacctcttctgaatcccatccccaggagtcaccaggagaaatggaatcaagagtggagctgactccagaggttacaaaggcactggcaagaagttcacagttcccattgaagagaaagacgcactgaggaaaataacgaagccatttgtcatcatctgaattcatgtgcgggaaacacatttgtttccaaggagcgtgttccacaaacttgtttaaatggaaatggacttgatttcaacagcaatgcagccttggtggcaatatgatgttttattttattgtttgcaattagtgacaagtgaggaaaatatccaaatcactccacatcgcacagggtgtgtgttatccaagtactcagctctgatgagaggatgggggctggggagatgtaaccatgaagaacttgaacctccagagaggaaactgaatgaagtgcgtggagtcttcaagctcttaaccagtgcagaggcattattgaaagacaggaagtacagctgacttttgggatgtagagaaaaccagtgaaggaaatttcccccaaagacaggacaagccaggagtcaagggaacccagatcagctgcaacacaggaggagctttgggaagaaatttcctatggtttgaaaaagagagacctctgacttctccattcaccagctggtaaaaaggccagtggtcactgtccagtattgcctaaggcagagttcctcagcctcaacactattggcatttaggtttggataattctgtgtgaggggtgctatactgtgcattgaaggatatttatcaaaggacattttggcctctacccactagatgctagtagcactcctctccagttttaacaatcaaaaatgtctccagacactgcaaatgttcccagaggaacaaaccacctcccactgagacgctctggcttgacttcaattaccagttctgaatcttggttgagttggaagaggagtccaggattttcaagagaaagttttgtccagcttagaaatgcttcattctgaggaatctgaagatcctcagcctacctcaacaaagcccaccattgccttcccaaaatggacctggggagcaggagagctcattgtcccttaactttgatctgcccaggacttcaagaaaaactaaagaaaaactatgagatgccatggggccatggaatgagcctggacttacagttctataggcctgggtttgagcccaagctcctcactttgtcacacgtggtctgtcctttgctgacctggacactccccttctctccatgctctagccacactggtctgctgaaaactcctcatatatctcccatccaagtattaaatcaggcctgaccctgcctagcttccaaaatcagacaagatcaggtgtgttcagggcggtatggctgtaggcttctcatacatctcacgtgccacctcaagacgtttgcacatgctgttacctctatctagaatactcccctctcccctattccccacactagacacacacacacacacacaaacatacacacaaaaacacaccctagctcattcactgtactcattcttcaggtctcagattaaatgttacctcctcacagaagctttccctgattccctggacaattcggtacccatgatacacactgcacctgtactattcacgattaaagaactattggtggggggaaaagttgagggaatttgggggaaagagaaaaagaagtaagcctaagagaacctgcccaagaaagagcaaaggaaataactccactttaaattttaaaaccatagagattaaaagacagatcagcggcaacaggaaggtttttccttgttgtctggcatctgtgtatgttcataactgctttccttctggtatggaaatagacctgcctaaccttccagatgcgaaagggggatggcatctgcataatcttatttcatgcttgtatcagccccaagtgataggggccataatattcccattttacaaatggagaaactgagacctcagtctgtactctcattcggaatgtatgtaatcttcccagaactgtatcactcatgagctgaaatttggatccaggtgcatgaagttccagagcctgtgctcctggccacctatagtgtgagcccaatgaacctggcagccaggagggaattggcccaatgctgggctggggcacgaaggtgactttcaataaatatttactgaatgagcagaggcagcagtgggattcacttcggggaaagttgaatccagcctgtgtgcagcggagctcaacccccgcctaccccaccccaccaccaccgccccacccccgctcacttatcaccatgtaattgaaataatgcctatcgacagaaactcacaaacaactgctcaattttcctcaaaattcaattaaacttcgtttattctggggatcgatccaattaaaagaaggaaaatttcagatggtctgagcaacaccatccatcttcaaacacagtgtctaccccagtgatgtaataatttgcccaatcaatgctttaaaagcatttagcagtcttgataatgaacttttgtcaaaatagccttgcagagcaataagtgcctgcagattaatatgaagtcataaagggctaatgccttggggtggaagggggatgacgacatgaatcagtgggagctgtgggctggggcatcatccttccacaccttctcagaactaggtatgagcagttagcaggacccagaaaatgctgaatgtacttccttgtttctgctctgtctgcaggttcctctcccctccacagtctcaagacccagactccaccagccaggtcctgtgatgctcagatcaccctcagggcatttcaggcaccccactgtattggagaaaatgtccaaagggaggaagctttgcttggaagaaagtctgcctcttggccatctaccatctctgaaagctctggcttcaaaaatggtctttgagctgcaagaactttcttttctcttaccctttttcttggggtattcaacttactagctgtgtgaccttgagcatgttacttaaggtctctgaccttttgtttcttcatctgtaaaatggtgatgatagcatttgttgaagctcagaggagggaggttgggttggatttctgggtgacaaagatgcaaagattaaaaagacccaggctttatctgtaaagactttagaggcaccaggggaaaagcaggtgaaaacaactacaaggcaagaagctagcactgttaaagatgtctgaagccagtactagaaacagtgcccaagagagggcttcaccaaggcactgcagtttgaacagcttttgaccaaagagcaggtatttgccaggtcaagaagagaaaggaaaggtgtataagctgagggggctgcaagttcagaggcccagagtcatgacaaggcttcctcaaggtgcacagaaggcccaagtcagagtcaggaaacagagaggagcaggctaagctagagctttgaaagtctcatcagctaggctaaggagcttgtcctttatccttaaagaaatagggagccacggaaggtgttaatcaagggattgatatgaggagaacagcacttggaaaagttcaatcaggcgaccttgagagggatgggctggtggggatgagacagtcagaatggtttaggtgagccatgatgtagccagggtggtggaaccacacagctccactcccctaggaattcccccaaccaccctctccccacactgaacacacccaccccaaattccctgttcccaaccagtgtccacatgcccccagacaggaagcccaggagtccctctacacaccttccttttccattccccgcaatttctagaatttcctcagaaatcttctgcctgaatgctagatcctgtttggacaaacatggtttctcatcccaaaaagttaagctcactttagtcccccacgaggcccccttcactctttcagaggaaggtcagggtacaaagttccttgcaaccagacaggggcatgcccagagttgtccatggtactggttgtgttggttccagaagaggaagggaaaggtgtttcccaagataggtcagaaaccttcatgtggagttcgaggcattcccctccaaaatcagtcacttctggggaagctgggccagtctgagctgggacggccaagatgggctgaactgggtgatatggttcggctctgtgtacccacccaaatctcatctcaaattataatcccacatgaagagggagggaccttaattcccacatgtcgaggaggggaggtgattggatcatgggggcggtttcccccatggtgttctcgtaatagtgagtgagttctcacgagagctgatggttttataaggggctcatcccctctcactctctctcctctgtctcctgccaccttgtgaagaaggcgattgcttccccttcaccttccgtcataattgtaagcttcctgaggcctccccagccatggaactgtgagccaattaaacctctttcctttacaaatcttgagtcttgggtatttctttatagcaatgtgaaaatggactaatatactgggcaagtccctgggccttgaagtggtccacaattcatcagagcctgccccgcctctctcactccagccctctaggctggggctaccttgcggggtctgtgcactgatgtggagaacaggatacagctccagcctccaacaccagcaattccttcagcatctcctccccacgcctgaactagccctttaaaaaccagaagaaaatatcaggggctggctggtgctttaaaagctggggatctgggtggccaaaggaatgaaactcctgctccactcaccggaagtcactgctcccctacgggatgccaggccctgacctgccatcacagaggctccagatttggaaagaggaggattaagaattaaaggggggagagggaagggaacttgtgctgctagatcacggggagtattaaatgatcccaagtccagaaatgccttttcaaagacttctgccattaggacttaatattaaatttactccttctgtgccttaaaaaatagctaattttttttttcaaaaggtacttttgatgccaaaggtatggcttaggctgaaaggcaccagcacatcaaacatcatttgggggatttcaaagggctgtttcagcaggatcctgttctcttcgtccccctcctcggctgatgaagtttctgagccccctgaagtcggatcttgtgttcttggctatcaaaggccccagcaacattgcgtctgtctgtctgtcccagtgaaacttttgcaaagaaagcctcccttttacacagagatctgagggcagaataaaaaggatgctgatttgcgaggaaacaggagggaagccctgctgggccgataggaatcttttgacttaaccgaggccagatttgaatacatttggcccagacaagggggtttgggatggaaatccattactttggagaaaagcttcacagggtttcaaaaggaaatatgttaatgttgggagaaatcatttgtgtgggtttgtgtgtgagtgtttcagatgcccccaagtttaacatcgccaaccaggagcaaaaagcaagagccgtggaattgagtcgccgctgttcaggggaggcataaggagctggaggactgggtgggctcggcagcttccctggtcttgcccctgcactcctcacccagctgggactagggtctgagactcagaccgacggggagccccagcctgaggcacagtgctcaaagggcttccctttccttaagatcccactcagagtctcaaggccaatgctcacagagatctcccagatcattcccagtgtccagaagcaaagaccagagcctgagaggggaagggcattgtcacagaggctttgcgggtcaggcctctggactcgagtccctggcccacatggcttctccccatacctcttgctcaacaagcatttgatctgctctctgaggactgcacctgggtgacagtttatacttctactcatggcactccggaaatgaagtgcctgtcacacccagccctgaggacagggatccctgtggcctgccttgttcaaggccccataaaaacagaataattactatcagataattagtcagaaatttccccctgtggtttcaagagacagtagccctggattcaggagccgtgagtcctgggctcagtttggtctccctctggtcctcactttcttcctctgccaaatgaggacaactccagcagtcccgtctctactttgtaagaccactgagaaattccacttaggtcagaaataaatgctgtgagcagggagtccccagagcagggcaacaggagcctctcccaccctccagtaggctcagacacagcaggaaaaacggagtaggttgttttaaaggctgttctgtgtggttgtagcaagtgcacctgagtcgctaagaagccttgcattctcacatcagccctggaatttcaccacagtttcagggctctcttcttcattaggaaaatggttgatagaatttgcagatgaaaagaagcctagggacttgtttgtttgggtggagatgagggatgcagtgggagttagaatctggggctgcctgatttggactcccatctgagcttattttacccaaggaaatgggggccagcaaaactcagcacttgaatcggagcattgtcctcccgctgcaaaagagaagagaaaaaagagagacgatagctcatcgttaatggtcttgaattaaattaaattagttgagcccatcttggctgcttccagccaggcagagaacggggctgctggggaggagcctggaggttccttttgcctcacagtccagtggccacccataaagccattgctgaccgtgcactcttccctcccgccgatcgctaccccctccccaccactaccagcagctccaggctgcaaagtgtcaaacaggatggtgatgggaccactgggataggggcggctccccagagcctgcaatctttggaacattgtcatcgagaaggtcaccattatcaggagaaggagggcatcctgagctcagccacaggccagactcccatatttccctttccaccttcttgccctgagccagagaggtagcaaacatgcacattggtgcccgagtcaaactcacaaaccagagtaatgcctgataacatggtatttgagtatagcagccctgggcaacccagagctaccagagtattgtttgggttcatgggctgtccaaggctctaccatgtttgtttgaacacacaggactatgaattctctctctgcaagtagtccaagtcaggctgtggccttccatgaccacatcagttcagttatcattcaagggatgcaaacttcccatcaggtagcacaaggcaatttaataccagcaaaggggcacagggctgagaatctgcggggtgcggggggcatgggtttcctgtcacaggatggcccacttagccatatgggaccctgtggctcaggactgaccccccagagacatattgagctccctgactcaggattgtcacactggggcatgctaagacttcctaactcaggcctgggcccccaagtcacactaggacccttcactcagggctggcccactacagcgagctgggacttccccaagaccaagcagaacattggctgctcagcccaaggctcggaggccaaagagcatccccagaatccctgcgagataggacttttaaatctatttatagataaggaagctgatacttggagaggtcaagtagcttgccaagaggacacagagcctaaacagctttcaagtaatgccaagagctaacctcagaatgcggtgactaaagctttccatgagattcctcctaccatcttcacaacttccatgaggcaggactagttttgtccagttttgtacacacagcagttgaaactcagaccggtcgaaccacattgccccgtcgcacagctggagctggaatcacaacccacagctgcagagccccagcagccaggcatagtggttaagagcccagactttggagccagcctgcctgtgttcaagtcctgcctttatccatttcccagagatgtgaccttggatgagttcttcgacagcttctcagttgccctacctaatggaaataatctttgtaatatagcaacggtcaggatctataattgatattcacagaacacttccaacagggcctgctaggtaccaagttgtgagtttgttagatgaatctttcttctgtacaaccatgatttcactcattctgtacataggagggttaaaactggcaaactggaggtccctcctctccaggctgccccctgtcctcttgggtccaaggtccagcagaggcacactgccaaaaggtgccccagacccagcacctgtaatgcttctgtcagagcaaacgaggctattaactgacgagctctgtgatagaattgtcccgtgtggtatttattatagggtcctttccctgagaccccccagggagagaatattaaatatttaatgcatgcgatgctgctcgtttttcatccccacttcagcactcaagtcagctccagtctgggggagagccaaagtccaccagcctggccccctcatgccttccctcctcccacccactgcccctctctctagggcacaaagccagacacagcctgggatgggaatgtaatgagacccccaccccagggacgtgcagctgagtcccacgtgaaccctgggaagggctcctccatcagtcaccctgggctggggggcctgcggaatgtcaggggaagcagcgcatctcatctgaagagttgcgatttgttggtcaccagagcttaggagcctcagagcaccctgcctgcatctcctcctctcctctgcacacatttctgactcccccacccacctgccagttctcactcaccacatgcacgtctgccagaggctgcttctggctgcggaagcctgctcagccagcaggcatgagccagaatggccagagagaccagagcatacctgctgtcgaccagtgatatacaacgagatggtgtatgaaaaccccagcgtcccatgcctttcgtgtgggataactcagggatgtgttctatgctgatccctgaggtccctggtagagccccacagcggccactgcccattaacacaccctatcttcgttccttttcctctcggctctcatttcccctctctcctatacatgcatcctggggtcacctcccaaataaacttctgcactcaaatccttgtctcaggggctgctcctgcaggaacctaaatgaagacaatggcttggtcgggttggggacttactagagaacataggagggtacatctcaggggagggtacatctcaggcatgtacttattctctcattgagcatctacctgctcagggtcaggccccgtgctggggctggggacacagcaaggactcaaatctggctcttggaccccatgtgctcccaagatgactggggcactgttatgagacactagccacagtgcagtgtgatcagcacgctctaccatcacccctggccatgcaaaccagcccaagtgatgccacatgaagataaagtcgtgttttcatctcagctcatcccttagtggaaacatcaagctcctgtacaaatgagtacattgaccatcgtggtccaaatactgaaagggatcctgtcaatcatattcatgtgaattttccagctttccttcttcctgtctttcttttctgggtgacctccacccatctgtgttgcacatgggtgctggtggctggaacagtgtgatctcgggtgagaggatagggcattttataagcatcaaggcctgagggtgggtgcagggaggtgaattttccattcccggaatgttgaccaaaggtatgctcccgggcatcaggccttgtgctttggacttcactgtacattaaggacagggtggctgagggggtccagcatctgatgggagagggaaggaagacctagtgatcaggggagggtaggaagctcagcattttacctccatgatctgtaatcctcacaacagccatgtgcagggctatggtttccttccattttacagataagaaaactgagttccaaagagattatgacttatccaaggctactcagctaggtatgcctcagagttcattacataccttcttccctcctctgcagcctggggaagaagaaaagaagcccatcttggattttgtcctgaggacaatgggtagccatgaaaggacaaggtcaatgttgcattttggagccatcatgatctatttagcccatccccgctgccaggctaggggtctatatagacccatccactcctcacccctgccctggtcaggacaggctctgggttgagaagctgaggcctgcaggggccactactaggatggagagcacagcctcgctcttcctttggcagggatttgatcttgcagggactcctgcctggagcagtcttcctccctcttaacccctttccctatggctggctcactatcaagtttcattatcagcttaactgtcacctcaaagagtgtttccctgacccctgttgtgggttgaattatgtcccctgagaaggtttgttcaagtcctcattccccccaccccctgaacccatgaatgtgaccttatttggaaatagtctttgaacatgtaatcaagttaaaatgaggtcatatggggttagagtgaactctcatccaatgactggtgtccctactaggggagggaaatctgggtgcagagacacagtgagaacaccctgtgaagatggtgacggagagccaagtgatcctgccacaagccaaggaaggcctggggccaccagaagctggaggaggcaaggagtctcccctagagccttcagagggagcatgctgactccttgatttcagactttccgcctacagaacagtgagggaatcaatttctgttgttttaactcacgcagtttgtgttacttggttagagcagccctaggaactaatacagctgctcactaaggccagtctccctcatcttccccatcacacatgttcctctcttccctccttcacccctgtaataacaatctacaatgatcattattgctgtgttatgtttattatccatcctactcactagactgggagccctaagaggggagaggccttgcctgtcctgttctctgctgtattcctagtgcctagccctgcgcctgtgacatatagtaggtgctaaataagtgttcacttattaacagagatttaatgaatgtctatcatgtgctagcactgctctaggtgaacaaaataaagagtcctatcctggcacttacataccatattcaacaaggaacataataagtaagtaagcttataggctattagaagatgatgaagttccatggacagggagaggaaaagtagggtgggataagggagatggggcattggggtggaagagaacaacctgcaaaattaaacaaagtggtctagaaggccttgctgacaggtggcacttaagtagattttgaaggagatgagggagttggccatgtgagattcttgaggaagaacattcaggcaaaaggcacagtcactgcaaaagctctccagctatgggaatatgcgtagcacttcaaagaacagaaaagaggaaaagaggtcaaggaaggtggaacacaatgagaaaaggggagaatagcaagggaggaggtcaaatatctgttggctgaaggaagggatggagggagggaaggcaggagggatgggtatagggatgggtataaagatgggtggatggatggatggatggatggatggatatggacagatggaaggaagaatagaaaaagggaggaatgcttcatatctgggaatcaaaagcagggactaactctgtcttctggccatatgttaagtcagtaactgacaataaaggggaccctacccaagaaaagtggccaattgcagaccaaaagaagtcagttctccacaccctttatagccataacacagcactacagaacagagatgaggatgcctaagaaaattgactttagtttcttggggacccaggatccccaacgagggctccttcagagcctgggatctcacccacccagatggctggagcccccacgtacaaggcctcaggcgctcccttagagccacaaaccatgaggctgagctggctgagactcctgacagctaaaagtggatttattccaaatgtatcactaatgaggcactttttgatacagaggccctgaaggttgcccataaaattcatgacaaaccactgagatatgaaatggaatcaagttggtttctaaaaattaggaatttccccttcgtcctccagctgcagctccagctggattgggtcagctccccaaggggcctgcagagcaggcccattgctaagaaccccctgggtgaggcccagaggcccggagtcagaggagtcctttgtccgcacaatctgctccttatcttgctccacccatccccatcctgcctgttctaggaaactttcccagccctccagacagggcacattgaatgtgtacagactttaaggctcatggttgctctttccctacctgtctcatctgtctcccccatgggacactctggctctctcccctgccctctcagcagcactcggcccagcttgccgcttggccttgcagcctcttcttttcttgctttgtgtggcatcacacaggcctggttctcctcctgtttctctggctgctccttctccacctttgccagtgctctttgttctacgatgcaacttccaagtgttggagcacccagggcttcaccttcagcttgctctcactctccctccataaattatctcatccattctcaaagttgaaatatcatcagtatactgacaacttctttgtttttgtttttgtttttgttttccatctctggttccagcctctcccctgaacaccagaattccatctttatgtggacttccaaaaagcatttcaaacttaacatggccaacacaaaactcttgatcttctgtttcctatctcagtaaatggcaccaccctatccacccagttgctcaaaccaaacaccaaggaatcttcctcaattcctctctctcattttcccttagccctcacatctgcaggtcttctctgctcttgttctaccactcaccttgaatctggttgcttctattccacggcttccaccctgagccaggcctccttccttcttccactccagctgcctccaattcactctccacccaccagccagagagctcatctaaaaatgtggactctgctgctggcagaagaaacagcagcaactgtgcacatgcacagagccccagggaccctctgggaaaggccagatgcaggctctccaggaagagacccaagcagcagtccagcaaacagcctgccacctccacactctctatatgctaagaggcaggagctggtgctgcccagagcccagcacatcctaactgctgattaccaatgacaggttgaagatccctaatccaaacatctgaaatctgaaatgctccaaaatcagaaactttttgaacgccaacaccacactcaaagaaaacgctcttgggagcattttggatttcagatgttaggttaggggtgctgaactggtaagtatactgctaatattccaaaatcaaaaaaaacaaatccaaatctgaaacactgctgctcccaagtcagataaatgatactcaacctatagtttcatgttcactaataataatataactctgccttttggctccctttgcaatttgcaaagtaatgccaggggcattaccatcatgactccttcagcaaccccctgggatcagtgtgatacccccagtcacagtgggggtccccacagtgtcagaacagggactgcatcccaggtcttccaaacacaggttccagaaccactcccaccaacccacccatggggtcttcttgaaataaacacttccattaccatcataaaacgtcccagaaattccactgttctgacactcaagtggcagcttccagttaacacggggaatatgggcaaaaatcctttgtcagttagcgggtcccagtttgggtttgggaaaatccttaatgtccatcattctgcccagtggtgctatactcaatcacactgttctagaagagtcttatctgagcgaaagctgtattttgagttcagcagtggagcccctgtttcactcactcattctcatcattcttaaccttgattacacctgagaatcttctggagaccccatgcccagaggccactaatctgttggcctgttgtggggatgggcttttatattttctaagtaccccaggtgattctaaaagacagccatagttgagaaccaccaacagttgatccataaacacatatggaacactggttgaaggctaggcactgggtgaacagagatgtcctccaaaaaaagcttctacctagtatggaaaatataaaggtaaacagatgattcaaatgagctcatttcaagtgtttgtttttgttatttttttaatttaacaaacgtttatatcactgtccagttgctaggcaatgttctaggcactttataaatttacaaatttaaccagtttagatctcagaccttagaacagtggtgaaggtattattactatccccattctccagatgatgtaactaagacacatggagcttaagtaacttagataaagtcacaacatctcatcagtgactgagccagggttctgacccagagaactggacttcatgtttctaaccaccattctctgaaggcagtagttcccacctcatagtagaatttgtgcaggacacagattcttggccccattcacctcccctcataccccctccacccttaggttttggttcaatcagctgagatgagacatgggaacatacatttttttttcacatgtcccaggtgattcagacacaggtgtcctggggactatcctctaagaaactctcttattaaataaggtgtggtggttttaaattgtgtctacaaatgctatgacactccctctaaaaaaatgaaccctccccttaagaatcagctgaacttagtgacttgcttctaacaaacagaatacagaagaaatgatattaaataatatgtgataagtggcttccaagaggaaggggcagaacaagggccagcccttgagccaggtgagatatgagaagcaccaggatgtaccatgcagagcataagagacactgcggcttcctcgttgccctctcttaggccactcattttgggggaagccagctagctgccctgctctgaggacactcaagcagtcctatgaaggagcctgcatggagagaaactgaggcctcttgccaatagcagtaccatcttgacacccacatgagtgcaccgtcttgaaactggtccctccagcccatctggccttcagatagagtgaccatacatcccagcttgcctagaacagtcctggtttatcctgttgactgtgcattccatgcaatttaccatttgtcctggataaaactatcctagtttaaccaatggtaaatgatatagttatcctgttgaggaacccaaattgcaggctaaggcatttggacttcaccctggaggctgtggggagccatggaagggttttaagcttaggagtgatctcattccaattgtgttttagaaagatccatttgcagaaaatgcaccagtgtgcgggaggaactggtatggagggtggactggtttggagaatgggtgtggaggcttgaccaggggaaaacaagatgagaagccagggaggagataaacacagtccctcagccagagtggtcagtgatcatgaccgcctatatgaaggctggagcagtggaagatggggtcacagtaagtttaggaaaacttaggagatattaaacaaacttggctgcggtaagagacagagaagcagcagccaggggtgattctgaggctatcaagggggtatggcccccacatttcagagcccagagctctgtctaaaaatagctctcaaatgagtcacctcaattgcagccaacaaggaattggctggtttgttattgaattgcaggatgtttggccaaacggactgaaaccatgtgtagccttggctcgagaagttcccactggacccagtctcttgctaggggcagtgccatagccctgatgcatgcataatctcactttcttctcacaacaaatcagcgagaatgccataatttcttctcatttatcaggcctgatagaagctgccaaatgcttctagaatgtaggctctgtaggcggcgcagccagaattcaaacccagacctcctcagatatttggtatcagctggaaagaggtttttttgggtaaaatccctagaaacattctcttgcctccttccagctgggatacattggctgaactcgagtcaccctcctaataaaaattccatgttccatcagcagaatgcttccatcccaattagatcaattttctctaagtagcaataaatgtgcttttctttcagaggccagcccgacacattaagtaggcttggggcagccattccccaagcctctggctacgagtgtgtggggtcaggggtcacagcaccaccacctccagctcattagtggggcccattcatctttgctgggacaccagcactcaacatggtggcagggctcagggtgggggtgtgtgggcaattcatcagggactctggttcgccagagacaggagcagaaaagcaggcctgctcacaggccggcaggagccctaggcccaagagctgagaaccggagctgcctggttaaaggttaacctggtctaggatgtctgtctgtaaggactcacagccagcttgtagggaaggaagggcccagggcaggctcctttcagatgcatccggctcctgcctgctaacagtttcccttccggccaactccccaagccgatccttgaaatccatctaagcaaggcctacaggggcctggagaatgatactgtcactctcctgtggtgcggggacctgcctggaataggccctttgatttgcaaatccagacactggaaatgggagcctaagagagccccactctatcctgccctgcctgggccactgggcctggtagaagcttgaccaaaagaatgagacctctcaacttccccaggactaaagctcagcctgcatcaacctgtgaacccacacacacagcccaagtcaccctgagccaagcagaactgcagctctggacatgggattctcagagtggcatggtagtagtttgctacggatgctgtattgatgtaccacaaactaagtggcttaacagatatttattctctcccagctctggatgctagaagtcccagatcaaggtgccagcagaaccatgttccctctgaaggagctagggaaggttctgctccaggcctctctcccagcttctgatagttccctggcctgtgacagcataactccaatcttcacctggcgttctgcatgtgtgtgtatgcacctgtgttcagatttctccatgtgtggtgtgtgtgtgtatgtgcatgtgtgcaacaaggtcttgctctgtcacccaggctagagtgcagtggcacaatctcagttcattgcaatctctgcctcccaggctcaaacaatcctcctgcctcagcctcctaggtagctgggactacaggtgcatgccaccatgcctagctaattttgggggtttttttgttttttggtttgttttgtttttattttttgtagaaactgaattttgtcatgtttcccaggctggtctccaactcttgggctcaagtgatctgcccacctccgcctcccaaagtactggaattataggtgtgagccactgcacccagcccagatttctcctttttcataaacacaccagtaatactggattaggggcccaacctacttctgtataacctcatcttaactaactacatctgtaaagaccttatttccaaatatggtctcattctggggtaccgtggttagggcttcaacatatgaatttgggggtacatacagccccaaagagccccattaactcttccccctttgggccatgtgagaggcaagcctcggggatcctcattcatttggcaaatgtgtattgagcacccatcaggcccagtgcaaggtactaggggtacagtggtaagctggtgtctgctctgtgggttcacaggtggcaggggagacagggacaatcaattacaaaagcaactgtacaattacaaattgtgctaggagctctgaagcagaggtgtgagcagctacaaaagtgcagaaccaggtcacactccaggtaagaagtcgagctggggctggcatcacaatagtgtaagcatcctcagcttccctgggctgttctgcagtgcagctgacccccacccacagctcctcctctcctggctatctggccccttggttatctggccccaacccctacccagcctgaggtctttcctagaagccagattcatggcatctgagcaacctgcccaggaaccaccgctggaggtaatctttctgcagagcccacgggcctggcagaggtctccctgattgacactcaccctggatgagccatcctctcagcagcagctcatccttcagccttccaggctcttgcagctccagcggcatctcagttcagccctgggactccagcacagaatacacattcagataatgaccagtaggtcttggacccaaatgtcacctcctcatggaagctttgctgacctgactcctccaagcccaaacaactcctcaacatccccacctcaaatgaaactaaacaatggattacagaattagctgttctgtatctgtctcccctagagactgtaagctttacaagaactgagacaactttctcatccacctccatatgccccaaatccaccctgtgcctgtcacatcatggtgttttgtaaacgtgagctaggtaaataaacaaaataattaattatttagtcaacctcctacttctttctaccaaaaccacaaattgagccacgggcttgatgcaagtccacggaactcctgacagtaccaggaaaacaaagacatggaatgagagagattgtgttcaggatggagggaacagcttgagcaaagacaagagagggaggaaatgctaagtgggtttggagtgagtatttggtttggccagagcaagactcaactgtgcatggccttgaatgctggacttaggtggtggttacagggtgccatgaaggtttttgagaggttgtggcatgatcagacttgggctgtgctgatgcggagagcaggtagctccacaagaaagtacaaaacgtggggccagagatcaggagagaagtttgggcgaaaccaaggttcaagagctgtcccacaaagaaggcaactgaggtcactgagggagagcaaaaagaggggtgaaattgtacagaatctggggacaactgtagtgcagagaagatgggttcaggaagggcaatatgatcaggaaagcagaggagtgaccagagagaggggaagaaagccaggcctgcccagcatgcttggagggaggccccacctttcctcatgtccttctgtctgcccactgtacggggcagggagaaccaatttcaaaatctgaccccatcaagaaccagctgtaacacctgggcaagtggatgtacctccagaagtctgttttcccatctgaagattggagctggacaaactcaacctgctggggtataaggaatgtgacacattgaaatattattgccagtcccagcacacagctgcctcctgggttttccagcaacacggtcctggtccaaatcagcagcatttcccaacctttgcattgtagacattttgtgctgcatgagtctttaatgcccacatgcattgtaatcttttttgttttatttttgttgttgttgttgttgttgtttgtttgtttgtttttgagacggagtctcgctctgtcccccaggctggagtgcagtggcacgatctcagctcactgcaagctccgcctcccaggttcacgccattctcctgcctcagccacccgagtagctgggactacaggtgcccgccaccatgcccggctaatatttttttttttgttgtattttttagtggagacggagtttcaccatgttagccaggatggtctcgatcctgacctcgtgatccgcccgcctcggcctcccaaagttgctgggattacaggcgtgagccaccgcgcccggcaatgcccacatgcattgtagggtgttaagcagccccccttggaacaaaaaatgtctccagtcattaccaagtgtctgacccctagggagcaaaattgcctccaattgagaaccactggtgtaaaccatgaaagctgtaggcaagtgtctcctactgcctctgtttcccagaggaggtcctatgtgcccatgccctcatgcattcaatcaacaaacattctctgaaccctttttctatgccagacttgtgcctatgtgctgggccgtgaagacggcactgcatagaacagtgatcctgcttgcagggattttacagttactgaaggaaacaattttgatacaatgagatctctcagcagggtaggcaggataatggcccccaaagatgtccatgtcctcatgcccagagcctgtgaatatattactttttatagcaaaaggcactctacaggcgtgattaaattaaggaacttgagatgggggattatcctggattatctgagttggcccaatgtaatcgcaaggtccttgtaagtgagagggagacaggagaatcagagtcagagaaggagatgtgatggaatcagcagttgtccgagtcagagagatgaagctgctatactgctgactttgaagatggaggaggggccatgagccaaggaatgcaagtggctctagaagcaggaaaagacaaggaaacaaattttcccctagatcctccagaaggaaggcatccctgccaacaccttgattttagcctagtgaggcacacttcaaatatgtgactccagaactgtagtctgtggtcatttattacagcaacaataggaaactagtattcacagtcacaccattaagcacagggaactgtaggatctcagggaaagcaacagggctgccacgtataattatccaggtagcacactgccaaaaatttgccagctgaggagatgaacgcggctgaaatttggcccacactccacttgccaagccgtgagcccttatgaggactgtgtttctgagacaaggagcatctttttccgatgtacatacaggcatttttcatttgctaaaagatgtgtccacccaggcttggggaggaggtctttcctaatttgcacaaaggagctacccagataactatggccctggcaagagactctgactcttcctgggatagtcagagaggccttcacagaggaagtaacatctgagctagatcttaaagaacaaacatggagcctgtaatcccagcactttgggaggccgaggcaggcagatcacttgaggtcaggagttcaagaccagactgggcaacatggtgaaatcccgtctctactaaaaatacaaaaattagctgggtttggtggcaggcaccagcaatcccagctactcaggaggctgaggcaggagaatcacttgaacctgggaggtggaagttgcagtgaaccgagatcttgccactgcactccagcctgggtgacagagctaggtgacagagtgagactcagtctcaaaaaaaagaacagacgtggaaagaaagtagagccattctacgaaagagaatagcacaaaagtctgtaggggcctgattcacttagaggaagaagaaggagctccacctggctggagcatcaggtacatggaggagatgattgggagatgcagagttcagcttgggatgtgcagagtctgaggggactgcggaacactcatggagtgatgtctaggaggtggccaaatgcccatgcctggagctctggcaacagggctgagctgctccacaccaccctcctgatgccattccagggagcccaccttggaccagactaaggcccccatcccaccagcccagccccagggacttctccctggctctcggggatgcctggctgttcaatgacttgcttttagggtctagtagtgtctgtccctgcagtggctccacttcctagcacttaactctaagacaggtatttatggtgccttgaccttccctaatatattgctacaaggtaacgtgggccagtcctgcagttctggtcatcccatggcccctccctgggcctgagcaaagaacaagaaaaaaccatcaagctggtcacgaggtttgcgatacaaatggcagtgagttgttttcaggaggcaaatgggcccccacagactaatggctttcagtggctccctccccctccctccctgagcttcccccgccccggtccagagctggcccagctgggaagctgcagttgctccagccacccccaccccccagcccttttgctgacagtataaccttcaggaacctgaaattcctgagtggtccccagagctccatgcatcttgaaagaaaatttgtgtaatgtcatttcaggctgtccctaatccagaattattgagggggggctgggacctgggaattgcctctgacacttgacaaatactcagctttgtgtaaatggacaggctcctgaaataactgcctttggatgtcatatgaagagaaattaattctttattaacttccgcaatgataatctaataaacccatcaggcctccaggccccaacatttaaagagcttggtagtttggatgcaaatgtctcctgaccccattttgtcgggaatatgttcatggagaggaggaataattgactctagaggtcagatgtcagctcagagtcaaaacgagtgactttcatggctccacacagacctgagactcaggaggtttggcctttcctgtggccaccagctgttctggattttctgcgatggcccttaatttcaggtattctgtccctttgttccccaaagagcatttgttctggtcagacaacagtctctggtttttattcagattgtgaggtcaccagagccctcacccgccagtaccaaggggccgttcatatattctttaactcttaggtgcggccaggtgctggaaggaggaatgcaaggcttctgtccctggggcttatggtccagtgggtccgggggagggaggagcaaataaaagaattaattgaagttataaattgagggcacagtggctcatgcctgtaatcccgggagctttgggaagctgaggcaggagaatcacttgaggccaggagtttgagaccagcctgagcaataaagcaagacccaatctctacaaaaaaaaaaaaaaaaaaaaattaattggccaggagtagagtagctgtagtcccagttaattgggaggccaaggtgagaggatttcttgagcctaggaggtagaggcagaggcagcactgagctatgatcaagctactgcactccagcagcctgggtgacatagcatgactctttattctctcaattaaaaaaaaaaaaaaaaaaactaggggaaatggtatgagggcaaaggatatctccacttctccttagagctgagcctggatctcagtcaccacgtgagtccacagtgtgagcaggcagcctggccaaaagggctcttgggtccctcaggccaggcctttctggtgaagtccaggctccatatccctaccatcagcactgacagaaacagaaatctgcacgtccatcctggaggcaggagaaggtgacaggaggtgcaggggcctgccagggcagagaaaccagaaacccccagaatgccaagggcagaagaccccagcctgatctggtgtctgactagtccctgtttgcacacctcccacaatggtgcactcattactgctcaaggaggccccctgggaaatgagtgactgcacaagttcttcttgaacagaccaatgtgtgtgtgtgtgtgtatatatatcttatatgtaaatatacatatatgtaattagcacataataaagctatatcacaaactagtgaataaatgaagaattattcaatctgtgatactagaaccaatggtttaaccatacggaatcccacagagatttagaaactcagtaaaaatgtagcaaaaaaactagaaaaagaaaatgtatatgaatgacatttgagagtagaaaaaggattctctaagcattaaaacactcgaagaactcacgaaagaaaagataatgaatgtgactacataaaaatttaaaatttctctcttataaacttgagcatgataatcaataccacttcttaaaaggggcaaaggtcaaagcagataattcacaaaagaagaaatacaaacagccaatatacatgtgaaaaaaatgttcaatcatgcatataatcacagaaatgcaagtcaaaacagcaataagatgccatcattcacctatcaaattgattttttcttaattgcaatgatattcagtgctggggatgacaagatgtgcactccctcacattgctggaagaggcgcaaattgttacaaccctcctggaaatcagctttctaacatgtatcaaggactgtaaaattctttctactagactctttaatatacaaagagcatggtttcaaaaggagggagaaatggtatagattaagagagacttgcaagttgcatcaaccaaatgaaaaacgtggactttcatttggatgctgatccaaacaagctggctctaaagagacattttttgagataattggagaaaattgaacatggcctgacattagataatattcaggaattattgttcatttgtgtaggtatgttaataacattctggttatgtttttaataagttattttacctatggagaagtaaaacaacttttgcaggagaaatgatacaacatctgggacttgttttaaaatattccaacaaactggggaggagatggataaaacatgattgtcagaatgttagtaattgttgaagctgggtgatccatgatggggtaggagggcccattatactattctctcctatgtatagccagagctttcctgtaataaaagatattttgaatatgtcagttgagccagccatccttctttgagattctatcctcaagaaattatcaaagatctgcacataatttgcaattttaaaaatatggaaccagcctaaatgcccatcaattcatgagtggataaagaaatgtggtgtataccatggaatactatgcagccataaaaaaggatgaattcatgtcctttgtagggacatggatgaagctggaaaccatcattctcagcaaactatcacaaggacagaaaaccaaaaaacgcatgttctcactcataggtgggaattgaacaatgagaacacctggacacaggaagaggaacatcacacaccagagcctgttgtggggtagtgggagcagggagggatagcactaggagatatacctaatgtaaatgacaagttaatgggtgcagcacaccaacatggcacatgtatacatatgtaacaagcatgcacattgtgcacatgtaccctagaatttaaagtataataataaaaaaaaagaaaaaaagagatgtggtgtatatgtgtgtgtgtatacacacacacacacacacacacacacacacacaccatggaatgctactcagccataaaatggcgtgaaataatggcatttgcagcaacctggatggaattgtagactattattctaagtgaagtaactcaggaatggaaacccaaacatcacatgttctcactcataagtgggagctaagctatgaggatgaaaaggcataagaatgaaactttggggacttgggggaaagggtcaggggaggtaagcaataaaagactacacattgggtacaatgtacactgctcaggtgatgggtgcaccaaaatctcagaaatcaccactaaagaacttattcatgtaaccaaacaccacgagttccccccaaacctactgaaatttaaaaaaaataaaataaaatgttaatttcacaataaaatgtgaaaaaatatgcagaaattttttaaaaatgtgcacaaagatttatgtacatagatacaaatgagaaaactggtcatgaaagcaaaaaaaaaacaaaaagaatcagttataagcaaaatatcccataacaagttatggtacagacaaagagctgaatattaagccaccatgataaaaagatatttttaaaatatcagaaaatgctcatgtgttaagtggggaggaaaaaagcaagatacaaaattgtatattcactatgatcccaattacctttaaaatgaatatagttgtgcattttttaaaaggccaaaatgttaactgtggtcatctttgggaggtataattacaaatgatttttatttgcttctttaaacttttctctatgcaataaggtggaaaaaatgtaattatcttaagacatggtgccaacattcctcttaggaaagaaactaagttggagaaacgctttgatgagcacatgggctagaagctgaatccctgaggcctggaccatggggaaaactgatgccaggccaagctttgtctcagggtaatattggcaggggggaccctaggaagaggggaaagcttggagaacataaaccaccaggaaatgcacagaattcctggcaagtacactgaataccctccccttacagaacggagcagtctagctcatttcacctggaactctgaaaggtaatgtctctctctctacaccttagctgacatctcagtaacctggatgttccaagttctctacaataagcaggcattgcttctacaatcagaagaaagcagtgttttatttttctttttgaaggaaaacaaagttttctttttcccaagctggaacttgcctttctggagccaccccctattgttattacctggaactatccagaccaagtcagcgctgtctctcacctgcagcctcagtagtttgaagacaacattcgcttcttctgtctactctagttcctctgatcatgtgttgctaatattgctgtggttctgaatctcctcccgaggttaagttatcttctctaggtgagctctaggaaacctggatcctgtttaaattctagtacatacacctgaatacaagacatctgaccagttcaaggtaaaaagtaactatcacctccctcaaactaggctctatacttctaatgatacatcctatagctatattacattattactgactcatattatgtcaattattaagctactgtctaccagcttcaaacctacccttccaagctctgctttctgatgctagaactgagactctgtaaaccacattttttcttggccagaaggcttcatgtcaggcttagccaacaggggcactagagggagactggaaggctgaaagaggaagaggcatgctccttcatgcttcctctctgttcatggtttagctcctgttccaggtagctttgtctcaacgtgctactttaccctggcagcagcatttagttccagcaactgaaactgacttcagttttcagtttttcaacccttgcagaaccagtctcatcacgtcccccaaaagacaccagcacttgccagctggcatttcctcctcagaggtctgagtcccagctccttgaggctcttcctcccagtttctaacttttaataataccaacctcttccctttgttccctcagccctcaatggctgcttcctgcagttgctctctcataatatctcaatgtgcaaacgttttgccttttcagctttctgatgacaaatggtctttacacaaaattcttcctgttaagatacctggtgtggtttctgtctcctgattggaccctgactgatacactgctgctgagtctcatcttcccccactgtatacctagtgggtgattttctagatgcaactgttagatttcctcctggtaggttttaacatagcttcagcctgtcaagagatggtcagatcctaatcctgtcttccaacgtgtttactatcccttccagtatcatgtcatctaccagtgtgattaacctatgctagagccctgatccacatcactaattaaaacaccacctagggtgttttaattacaggcatggtggctcatgcctgtaatctcagcactttgggagactgaggcaagtggatcactagaggtcaggagttcgagaccaacctggccaacatggtgaaaccccatctcacaaaaattagcggggcctggtggtgggtgcctgtaatcccagctattctggaggctgaggcagaagaatcacttgaactcaggaggtagagttgcagtgatccaagattgagccactgcactccagcctgggcaacagagcaagactctgtctcaaaaaaaaataaaaaataaaataacacccaggacagaggcctccgtaaactgaagaactccctcactttcccccaaagcaccccccaagaggctttcctcatacctggatactagtgaatcacatcagagctgagagttctagaaagccttgtgtgtgtgaatcttcctgacactgcaatgacagtgagtagggcctggctggtgtcagctgtcatggcctaggctccctctggagaggatggatctctacagtgagaacctggtgcatcacctggagagccacaccctagatctggaacaactaggcccccttctcttggaattcactgacccaggtccagcgttcatgctcctcactaatttcacagcaaagcagcagtgcaaataatagcaaaagtctgttttgtaaattgcatcaattatataattttcccaggaatgatttttacatataattagctcaaattgtcttacaaaaactaaaaggaagttgcatccaaaaatagcacatgggttttggtttaccttaattagaaatgcttcctttaaaatggaaataagcaatcttgcaaatcaaagaggctccaaggtcaggtttggggaccccagaatctcttggggaatccaggtggttcttggaggatagatcttcttggaaagaggttttttatttagtcaagagacggtcactccaggtggtctcacctctggtgttggggagcaagactctcagaaagaaaagagacataaatcattagcacacacgccctttcttccaagcactatgcttggtctagacccctccacgtggcttatatggtcctcacaaagaccctgcatgccttaaaactgaggcagctgagttttctggggttgccatgtttgcctaacactacaaaggcaggaagtgtcaaggcctagagcgcaacccagctttcccccatccttcctctctaaactgccgtgataaccacagaatatcagtggctttgcaaaatgacatttatttctccctcaacaaaagactcccaagggtatagctgactgagcagctctccaggaagttatccccaagcaaggactccaggatcctggccccaagtccctctttttttcttttcttttttttttttttttttttttgtgcgtgtgtatgtgagacagggagggtctggctctgttgcccaggctggagtgcagtggcatggagtttactgcaacctctgcctcctgggctcaagcagtcctcccacctcagcctcccaagtagctgggactacaggcacatgccaccaagccctgctaatttttgcatttttgtagagatggggtttcgccatgttgtccaggctggtcttgaactcctgggcttaagacatcctcctgcctcagcctcccacaatgctgggattacaggcgtgagccaccatgcccagcctccaagtcccctttatgtcaaggctgtgttctctgagtcccatccactcagccaattagacaggaaaggagacaaagtgtggaaagggcacattccctcttaactacctctgctcagaggcagcaccaatctcttctccttacattccatcagcaagaactagtcagacagaaggggcacttgaaacaaagctagacaacattcccagaggcccctgaatctgagtaggtccatatgactagtttttgctagtggaatataagcagaagagatggtcactggtgagcctcagacatctctgctctgaagcccaccataataaccaggtcttaccagttccttcccccaagactgcagcctgcttcccttcccttcagttcccggctggattcctggcccagagccaaagataactcatccctgtgacggcatgtcatctctgtctgtgacaagacctcattcacccttggacaaagatggcttctggcttggcccagaccaggcctgccaccaaccacccttgggcatttggtggggccaggttcctggtcctcacccactacctctccactcctctgccctgcttccatcccaccactgagttctgtatctctttactagggctactgtaaaaaagtaccaccaattgagtggctaagaaacagaaacttactgtctcacagttctggaggctagaagtttgtgaaccaggtgctggcagggttgacacctggagtgcagtgagggggaatctattctgtgcctctcccctggcttctggtggtttgctggcaatttttggcattccttggcttgtagatgcatcactctgatctctgacttcaacgtcacatggtgttctccctgtgtctttgtctctgtgtccaaattttcccttttataaagacaccagccatactggactaggccaccctaatgactaatgataataattttaacttgattatctgcaaaatctttatttccaaataaggtcacattcacaggtactctggggcaggacttcaatatctttcaaggggtataattcaacccataacaagaccccggaacatagtagggtcttgtctgaagatgccttgacagtcctgggcaaccttacctacctaataaccagacaggaggaaaaagtgttcctcggacagaaacactcccaatctcctatccccaggcttggaatgtgagtggtatggacagcaggcacatgagaaaaggaatgcaatagcccctcagagccctgcaacatcattagcctcatgatgattaataagtattaataagttattaataaagattaatcaggacctttcccaagagctacagaggaggctggctaatagcacaaaacaaataaatgaaaacaactaggagaaaacctgagttttcaccagcctgagaaccaagtggctacttctcacctcctggagcatgtgagccccaaagcagactgagatataaatcctgctttgccactttttggctgaaacattttgggcaggctcatctcctcccccagggttgggtgaacatcatataagaggtgttgcaccacatgagtgctctgtaagcattggtcaagtcttggaggcaaggcctgaagctggagccttgcttgctacagccgatccctgagccacggccaccccaggcccagctcagcctgaacagctaagcagaggaagcaagccccagatggggagggcagcctcagaggtctccatcccttagagaatctgatggtggtgacagacccaaatggtcagcaacagcagtgacaatgatggctcaacccactctccaagagatccctatgtgccaggcaccacaggaggcaactgctgttatcaccctcactttacagaggaggaaattgaggctcagagaggttacaaggcttctcttagatcacacagatggggaatgatagagtcttaggatatgacttgacacagaggctggacaagacttctttctgctcacccatgcctgccaaggcctgagccagtaacacctataatggacacaacatggcgatggagttgataacacacacacatgcacacctggatttcagaacatctttagggactaggaccacatccctgctgtatcctgtttcacttttctcctgatgctcctagaacctccccttttgaggttctcagcaagtttatatttgggaataattgtaacataatttgatagataattagagcagaattaagttaaaaaatgagtgtttttaactactcatacatccccatgtcatttaaataattcctaatatatccaagccacttgcttcgtgcagcactgatgtgtattgaactgaggataatgaaatacgggatggaagagggaaaatgctatttcagagtctgaagatcaccaattaatgacatgaaaaaccaagagggactctgttcacttaatgtcccctgtgtaggacacaaatgcaggaccccctagcaggctccctgttcagtgcctccaaggcaatcatgacaggccagagggaccaggtggaagggaaacggcaggggcagctccgagagaccgagctgcctctgtgctcccccgaccccccagcaggaccagccattcttgacatcccatccctctgcagttctgacacagctcttcccataatgcctctactcattatccaacacacctactgttttatgctaacactgagatcttgtaacaaactcagaagccttgtcctactaaaataatgcatccactcaacccctctattcatcacggtgctggagccctgaaggatctggtctccatctgcacttccatctaaggccatttgccactcactcactctcacctcacaagctgtcttttagttcttcaaagactggaagctctagggcctttgcatgtgctgtcaccttccaaccccctcccctatatagacacacacacacatacacacaacatcctcctcttgttttcccactttggcaccacagcccaagtgctgggtatgaacttggtatccagaaaattctttgccctgaagttctccaacagcacagtccccaagaaagacagttcaagtttggattttctcccaaatgacctctgaagaggggatttaactcataggatctgaattggcttcctctccctggagagagcctggctcagggacaactggagcacaccacagcccaggatggtaaaccaggcaagtggttcctgcccaggaacactactgtaagccctgtgctgcctcatctgccatcgtccaggtgcctgcccatggctagggtgtagcaccttcttgcaaagcatcccacactgctccccctcctccccagctctctgaaccctgctgaggtttggagtcccaacacgattgtcctcactgaccttcccctctggtccttattggcctaggagttctggcaaggacctcggggttcagtaaccacattcctgtacaagcatcagagcccggctcacactcaaaacactgcacaccttgaggacaggctggctcctccattgctggcccctctgtgcaccagagagaccaaggacttggagacaggccctgtctcaaatgttgggtcctaaagaccaatgagcacatcagacctcattgtcctgattcttggttcagaaaatctcaccacactggtgttctctccaggtttccaggcagcaaagtggagaggctgggagctcagacttccaaaccagacttcagatccaggctctcccacttactaactttgtgtcctccggtacataactttactctttgtgcctgtttcctcactggtaagtggaggtacatggtagtgcctgtgtccaagagttattgtgagattaaatgaattcacattagggtcatcaactgttctgttttgcccggcactgtcccagatttagcacaaaaagtcctgaatcccaggaaactcctcagttcccaggatagccacctgagatagagagagagagtaagagagagagagagagagagaagatacagtgcccgacacatggtaaatactaaataattttctttttagtttgagctaaatgtcaatataccacttaacaaaatgtgcccctcccttgccccacatcccagcagcctcacaagattgatttggggactaacccagtgcctgaagctggcttttccaggtccctgtgtgaggcagaccccttcccactggcccaggatgcctggaggggtccccatgcccaggaacatcctggcccatggctcccctcccctggtaccagagtctttctgctccaaacagatgggcccctgcggggacgcctccgcaccctcggaagggccgctgtttggccaggccccagcccctttcacactcaggtaaaactttaaccacaggcctttggcggcattgccgggccctgcgctcccattcagggcatgataaatgactgctgtcaccgtgacatgaatgctcatattgaaaagccctgctttctgtcttcctccctttcaggccgccaacttctcctctcttaagtcgccgggcgtcactcacatgtcaccctgtcctgaatgcctcccaatctggcacccctgctccctctgcccctcgattcccacctgccccacccctgccccttcctctctggtctcctgccccccccccgcctccattctctcattgctcctccccatcctgcagagcccccaccccaccatttcctcctccttcagtcctgatttgcccatccccatctccggacaggggaagctcacactcttttccccatcactgtccccacagccgataaccacacacaagccctccaccaccgtgtctcaccatcactctccatgctagagttgccttggcactggcaccgctgatgccaacctacagggaaggaaagtgacacccaaggggacccctaaaagtaagtaagagagcagattcacagtgccctaatacagtgtcaagacagtgtgctattgtgtctgtgtgaatccgtgttgtatttctctgggaataggaaacaaagattccatcagatcccccaaaatggaccaagaatcacttctcagaggctctgctcatcccataaaggcttgatgaacacctattggcactggaaacaccaaattaactccacatcgtggggatcaaagccatgctgttgggacaggggacaccacaactctgatgcctcagcccaaggggtttcttttcttcaccaatgagttcagctgccgtaagaagatccacaccagtacagcccaagacagctggggacaaaacccactacagaaggaaacattgtgtggcattgttgaagccaggaaaaactgctgggttttttgtggggggggggtgtgggcggggtggaaaactgaaatttgggggtgggaaatggctgagtgtagtcttgtctgagccagtgtcctgaaaagctccagcatccatcagtctggcagccaaggaagctaaagatggttctgcctggcagagtctgcccagtaagctacctcatttggcatgttaaatataaaggtgtattttggccaggcatggtagctatcacctgtactcccagcactttgggaggctgaggcaggcggatcacttgaggtcaggagttggaaaccagcctgggcaacatggtgaaacgctgtctctactaaaacaaaacaaaacaaaaattagctgggtatggtgacacatgcctgtaatacgagctactcaggaggctgaggcacgagaatcgcttgaaccttggaggtggaggttgcagggagctgaaatcgtgccactgcactccagcctgggtgacagagtgagactgtgtctcaaaaaataaaaaaataataataataaataaaggtttatttcattccgtaaattgctgatcatttcatcatggagatgactttcaagtggctttcactgtggtaacaaatggaacagcaaggcactgggtatcagaagagcatggtagcctcctgtatgccagggtccctcaggaccaccttccaagtgcatttccaattccacacctaccctgggggcccaatgcccagggctgtcttgagacattttcatgttaggaacccctgtgcattgtgagaaatgcgtgcgagcatacagaaggccattgctaagtcttctgtttcccagaattcactgagtgtgggaggaaaggcagagctccactcattctgcataggatatcccctctacctcaaagagaagagccaccctaaggttaaggaagtaccagacatgggcctacacaggacatgggtagccacacctggcttgccaaatgcagagctgaggcaatggatttagttccatgagaggctgtattagtctgttctcaagctgctaataaagacatacctgagactgggtaatgtataaaggaaagaggtttagttgactcacagttccacatggctggggaggcctcacaatcatgtcagaaggcaaaggaggagcaaagtcacgccttgcatagcggcaggcaagagacagagcatgtgcaggggagctcccctttataaaaccctcagatcttgtgagacttattcactgtcacaagaacagcacaggaaagacttgccctcatgattcaactacctcccactgggtccctcccgtgacatgcagaagctacaattcaagatttgggtggagacacagccaaatcatatcagatgccctccaaataagactctaaggtcaaatatactaaggaagcaccacttgctaatatacctttcttagagggtcacaatgaacattattgttcagaacttattcagagttctgagggatcctgcagtaaataaacctggatgacccagggtttccctgatttacttgactctctttgtgcagaatatccatcgatattcctagaaatattgtcttctccaaggcgcattacctacatgacctcactctatactgataatacctctaggaggtggatataattattaacccatgagacagatgaaggtagtgaaactctggaagattaagtaaattacataaggttccacagccactaactagcagagctgggatttttctgattgctaagccgattacctgaccatttgattcttgaggcatgtgaggatgaacttacaaaaagtagacaccatcctaaattagaagcaatgaaaggaagtagcattttctcaatttggtggcctctgtggtgtaagacaaacataggatgtgctcagtgtcagaaagggagagaaggtgggagaggaggaaaactccactgctgggtcctgaatactatcataatctcccccaaggatttctgaatgcagttgtccctaccaacagtttcctctactgagcatattcccaggttgctgcagcctagggatttgcctagcttgtgatatatttcatgcactggtttattcaacttcctgatgaaatctgaggacctccaaacatagaccagcttccctcacccagcagcagaggagacaggaggaagtcagaatcagaaggagctagagtcagccatcaggggacaggagggttgggttgggcccaatctcagagacactacaagaatcatctctcaaggtttccacctaacgcacctccagaaagagataccaagtagcctgcgccaatcaatacgtggcaatctatccttactttaaagccaccacctcctctctcccttttgatgataccactcaatctcagagacagagtctagctgctttaggctctttggtccttgacatcattaatttccccactgaataggccactttgaatttgatcatttattacttgcagccaaaggctttctgacagacacagatttttaaacagattgttatgacacaatgtggcaagtgccataatcaaagtattcacacagttttctgctgagacagcagaaaaagagaaatttggcttacttggtttggggaggatcaagagaggtgatccctgaacagaatccccaaagaaggtttgttcacaggcaacaaggcaaagaggcaggaactaagaaggggatgttattgagcacctactacataagaccttcaggtacattctgccactgagaaaacagagagtatgtaccctcccaaggggtcatcactattaattggctgagccagaatttgagtctgcttgattttgaagtccctattcctacatgctgtctcaatactgccgaccaacaacaaaatggacattcactactactgtgaatgggtctttagtaaagagactctcactctgatagcatcaggaactgcgactgaaagaggaaaggtccttagaaccttctggaagttctgcaattgagcctagaaggtgttttctacaagcacaaattccttgggcttctagggactttgagatcctcaattccaagtattaccttaaaaacttctgtgattttttacttcattctcaatgcccagtctcctgtagaattttactgtggaatttcagtgttttcctttaactctttgtgctagaataaacaggagctttggggaaaacagatctattttgaagttctgctgtaccacttgatagcctgggtaacctcttgacattgggtaacctcctgacattgggtaacctccctcaggcccagtgagttggtcacttgatgctgcacaaattattttaccagctttttatttcctcagctgggaaatggggataatactcccaatcatgtaggacttggagaattaaatgagataatgactggcccatagaagtttctagatacatattagcttccatcttcagtctacagtcttttctgcttaccttcttgaagaatatgtcaaatcaaagcaaacaatctgcccagtttggctcatcaggatatccccaggcaagggcaatgttaaaaacatttaacaaccaacacccccgaggcatcaatcaatcgtactgtacgccattggtacaaggctacaataaacactgcttaaatatttccccttttcctaaataaaaagggaattaattctctctcctaactacacattctctgcctagaaatgaaaactggccaccccagggctgctgaccaggctagtgtcatgattataaatctgggatggagctcaagccaaaaaatattaataccttgagccaaataatagtaatagctagcatgcactgtgctcatgcactttacatgcatgagaatgtaaatgtatgtatacattacatacattccttcttcatccccataaccatctcatggagtagctattaccattatcactattttgcagaggtaaaaattcaggcccagagatgtaaagcaaactgctcacagccacagaaagcatgtcagtgacaggtctgtctggcactaaagtccatactcgtaaaggtggggcactattgtctaaatttctccataattgaaagtccagcccttcaatgccccccattctttaccccatagctgtgtacctggttctcaagtcacacaaactcttcagaggcagcacccatttctgtagatgttcatgtcttaggtcacattctgcacaagcagactctgagatctgaaacaaacacttgggtgcaagtgatgtattagagaagtgctccccagacatactggtaagggattgacagaaaaacatgataggaaagaggaagaagccaagcaaggtgtagtcccagacaaaaatcccactgagggtagcttcagcctattcacaggggagctctacagagtaggttacacagcagggtggccctgatccaaggcaagagagctccaacaagagaataggtggagatgagggtgaggacggaaactgtaaactcccgggaacattctggctctctgtttatgtgaacaaagtgactctaatagcccaagccaattttccaaagaaaagagaagacacaaaggctagccattgagaacatacccaagtcaggacagcaggtggggatgtgcactgaaactgatgacctgtacagagcatcagcattgctacagtcaaacagcctgaggatgcacactgctgtgttgaagtccttctgctttcatgactgcaatccttgagctgagttgacagcataaattggaacatgggctcagctctcaaacaccagaaagagtgggtactttctcggacaggctagaacttttcctccttctggatcatgacagcaaatgggtctcctcagagagtgacctggtgctaaagggtgacccaacgcctagactgatcattgtgggtaattttatagactttgcaagaccccctgcaactgaagtcatgattgcagtgctgttattgctgatttttatattattttatttaacaaattaacttctatttccagagtacaacctcaaaaatgaaaccttcagccttctctcttgccaagtagatctagatttctattacaaaaacatatcttgcatcactggggaaaaaaaagccttgacaattctgctgtgtgttttcaatgccatgtttttgtacattcaggtatcagcttttaggaaaatcaatgcaaaaagggggaagacttagcaaacttgaacctaaaatgaaaatttcttctttattattagtgagtaatcactctcacattagtgaattaactttaaactatcaggcttaagtactgactaaccctcaattgatactttaagttgtattatagttactttcaaaagtaaaaatataagtaataacatatatattcaatattatatatcttgcatataccatgattaatagtattttttaatttttcaagcttgctgtttttaaatgctagtcagggacaaggtcaggggtggggtagggtgagcaggcatcagattgcaaaggtccagccaggtcacttagatcctgggcaatatcccaagggttgagtctggtaaacacacagcatctatcctgttcaatagaaaaaaaaatcattttgggatgtgttaggtttagggctcaaataagcattcctgagttcttcctgttccctgacccagctgccacagagagatagccagagccccaaatccagatggaatggaaccaggcactcagttcatgtcctggttaccaagaatcttgaccaatccagctccctgtcttctccagggccttcttccaagagtggagaggggtcctcccacacaatcgcaaatcccagccactcagcatatccctgaggcttggagaaccatgggtttcattatgaaagagttactatgtaccagatcctctaaaaaacagcttccagacattattttattataattgcatagtgaccctgagaggcaggtatggcagggactgtagtgcaaaattcatgtgctcctctacatttcccaccctctcttgcaactagtgtgggatcattagactgagttgcagcctgtgaactgcaatggaattgatgtccacttccctgaccactctcaggcctaaccacagacttagaggtcaggaaacattttctgtaaaggactagttgggcaatatttcagtctttgcagtccgtatgacctctgtcacaactagtcaactctaccactgtcatatgaaagcagccatagataatatgtaaacaggtgggtgtgactgtgtaccaataaacctttatttataaaaataaactggagattcaatttggctcatgagtgtagtttgctgatccctgccttaaaacctggctggcttatttcacaggatacagtggggaaacctgagggggccctatggaaagacagagccacagaattaaagggcctggttccctgagtcactgctataaagttgcctaacccgtattatactgccacagaagcaagaaataacatattgtgttaaaccacagggatttggggactgtttgtcacagcagctgcactgattaacccgactaacaaaataggttaactgttcctttttgacagctgtgggaaatgaggttcagagggggaaaggatccatccaagtttacaaagcaaagaaagagtagagccagggcttaggacgatcaactcatcctggcatgccagcatttgcctggttttagcactgaaagcccacatcctgggcaaacaaggtcacctagctagtcacccagccaggactcaaacacaggcctgtctggctccaaagctcgtactcacagaccatgaggagggctgctttctgaaaggaggtggagtgaggctcagcttggctcagcatgattcctgctgggaggccccccaccctggtgtccgctccaggtgtgctagagcttgcaggtgagcatggagcctgtcatcttctccctgcaggcctcaggctttttccccaaaggcagtaagtcaggcatgaattttaaatatataccagcttgagtatagacgtcaggcctgacatctataaaatggcactaaatcctgcttttatgagctcttgctgcattctgctgagtgttttatcacactcactggaagtctactgaggggagttaataacccaaaaactctggggcctgcctgtctctggattcagaagtggaacccccagctgtggattttcgagatgttagcacttgcactaaagatgccagcacctccagatacctgtgctctgccctgcctaggtccttcctgctgctcaattttagccccaggctggtgacttaggtggttggggaaggactctctgagagggcaacctttgggctgaaacctgaaggttgaaaagaagatggtcatgctagaaatgaagcgggaaaggccaggcacagtggctcatgcctgtaatcccagcactttgggaggccacagcagaaggattacttgatgccaggagtttgagactagcctgggcaacaaagtgggacccccatctctacaaaaaatctttcaaattagctgggcatggtggtgtgtacctgtagtcccagctactcgggacgctgaggtgggaggatcacttgagtccaggaagtcaaggctgcagtaagcctgcgctccagactgggcaacagagaagaccctgtctcaaaaagaaaaagaaatgaaaagtgtcccagagacagaacagcaaaggctaaggtcctgagtcccgtgacacctaatccagacagagaaggctttccagtagaggactgcagagaaccaggacacatccctgaagaaccacagcctataacagatgtccaaaagggagacctcagcagaacagtcagagaagtgggagggaagcccagaaagccaggaatcataggtgctaagagaggggagcatttcaaggagagagagtttggtggcatcagatgctatgaaaaacctaatttaaaaagcacagaaagaggtcccttggctttggcaatgccaatgtcacaaatatttaagtgcttactgtgtgctccagggtccaagctccagggaagcgacggtcaaataaagcagtagtttgggggcagggagggtaggacagaaaatctacaagtaattccaatgacacatgttctgttctgtaggatcccagaagtggggcaaagtaactctaccaaggagttgagaagatttctgaaaagtcagacatctgagttgggctgtgaaggttgaatagtttactactaaggtgatgagatagaggaaatatcatgggcaaaaatatcagaaagatatgtttaggaaaccaaggaagtcccttagcctaggggagatgaggctgagataattgggaggagataaaggacctccagccctgccaagaagttcgggtttattctccaggcaacagggtggcatggagggagacgtcagatttacactttagaaaataatttctaaaaccctgcacactatggtgtgtgcctgtaatcccaactacttgggatgctaaggtggcgggatcacttgagcccaggtgttcaagtccagcctaggagagctagtgaggccctgtctgtgacagagagaaaaataaaagaaaaaaaatagtttctggctttgagtcccatccccagctctaacactaagcggcagagtgacgctagacgcatcccttccatcttctgggcctcagttttacccactttgaagtgagaagataagactatccgttccagttcttatgatctgagggttctgtggtccttccccaaccacctgggcacccatgtaagagtcagctgttctgaaagagccttttgtttgtctgcatctgatacaaataaattcatcgcttaggttccaatttcagagtcataatttgcccagcacttttcagaagagcaaaatgactctcagggtcaaccatgccaccagcgtgtctaagaggctttttcccaattccctggtgaggatgagaaacaaggactccatcgtgacccaggggaaaggctgacatttggtgagatgtctgtatttaactcccactgcttgacatctgctttcaattaatctgcctgtgttaagagagatgctgcccagagcatgcgattcaacctcagttctggaggggcagagagaagcagtcacagagagtgaatgcagatcctagccacccactgcccccaacccacaccctcaggggctccctgaacccccaggaccacctggcctgcaggcacctgagggcctacttcactcccacttcacaattgacacttcagcaataccaaccgggacacatttgaaggactaaaagaaagtcaaactgaggtcactggagacactgacaagagaggacagtggcttagtgagggaggcaggggccaggtcacacaaagccttatagagcatgtgaaggagtttctgtttttatcctgggtctgattagaagtgacattgttaatttgcatatttgaaatatgtctccaggtgcttcatggagaatcggttggacagaggaaagattgggagaggagatggcttcaaactgcactgtccaactcagcaggcaccagccacagtgagcacttgaaaggtggccagtgcaattgaggaaatgaaattttttgctacaggcttcattttttatttatattatttttgcatgtatgtaaagaggcacaagtgtaattttgttacatacatacattgcatcatggtgaagtcaaggcttttatggtgtctgtcacctgaataatgtatattatacccattaagtaatttctcatcatccaccccctcccacctcccaactcctttgaatcaccattgtctatcattccactctctacatccacgtgtacacatttagctcccacttataagtgaaaacatgaggtatttgactttctgtgtctgagttgtttcacttaaggtaatgacctccagttccatccatgttgctgcaaaagacatttattcttttgaatgactgaatggtggaactgaatattatattttatttaaattaattaaagttaaagtaaaatacttaattcagctattttaaaactttgaagtatgtttggaacaacctaggtacataattctactttctccaacagtaaatgttatgaaatctaaatacgaataaagtattttcaatggaaatttatcatccaaattgaaatatgctgtaagtgtaaaatgcacaatggatttcgaagacttaggacacaaaaagcaaaagaacaagtatttcaatcatagtgtatattggccatgttaagatggtaatagtttgaatatatcatgttaaataaaatagattattaaaactaaattaacttgtttatttttacttctttaaaattttgtcacaagaaatgtaagcttttatgtgtggctctcgttgtgtttctataggacagcactgagttaggaggaaagatggtgatttagactacagtaatgatagatccgagatatgttttgtaggtcacattggcagatcttgctgataaattggatattgggaacgagtgaaggaagaggaagtaccagagatgatggctaagtttctggctccagcacttaattggaagatggtgtcattttcttgaatgaggaagacttggggaggaaaagctggggtaggggtggggactaagggttcctatgggacatagtgagtttcagatgcctgtaagatgccaagcggagagccgggcatggtggctcatgcctgtaatcccagcactttgggaggctgaggtgggtggatcacctgaggtcaggagttcaaaaccagcctggccaacatggtgaaacctcgtctgtactaaaaatacaaaaattagctgggcatggtggcatgcacctgtagtcccaggtacttgggaagctgagacaggagaatcacttgaatcctggaggtggaagttacagtgagccgagatcttgccactacacttcagcctgggcaacagagagagactccatctcaaaaaaaagatgccaagtagagatataaaacagacagttggatgcaggggcctagtattcaaaagcaaagtctggggagaagatctaaatttggaagcaaccacttggaaaaactaggtttctcctctgtttatgcatttcacaacagacagacagacagacagatggacaacaatgttaatgcactcccctgctctccagttacagtaaaatccttctgaatattcaaatgttccctggagctttgagtcttctctgtatttcacgagccaccagctctctcttcttcactcctccctcccacccccctgactcagataatcccttccttggctcgcccacccccaaaacttgctgggcaaaacactgtggcaaagacacccattgcagacagtcagtagcagcaagctatgggtcaggatgtttgcacaaatgcttcacagcatcatttatcttgagggatgtcaactcgaaaaatgttagttcatgtcactgtcagggtaaatgccaaaaattagctttctttcatcagaaaacggaataattaactttgcaactgtttccaaaactgctaattaatgggttttacccacttgatttgtcaggctacattgcgagctgaacagcagcctgagcccctggaggattcccatcctccccttctctctgtccctgcagaagttggaagaagttacaggtaaacaagtagagaaaagcaagaccagaggaaaacgctgctattttggagtcgagagttttcctttgcctttcaaaatcggtctcctaccacttttctttcccacatcactccaatgggaggtcaaaattccccagttgatctcaaaattgtgttgctcagccttagcggatggggcaaccatctacctgtccccaaatctggaggtcaaatcagattcctgcctgtctccctccacaaggtggtgggcacaggggttaaagacaggccttggaggcagagggggctttgaatgccagctctgattctcaccagttgtgcaaacttaagcaagacacttcccttctcactatctcagtttcctcatctgtaaaacgggattcatggtagagtgatgtcattgagtgggtgaacgctcccaaatcttactccactataccaaggctatatatccacaccttttgccttttaactttgcagggcatcccattgtgggaagtgtggggtacttccctttgatttttttttaattgtggtaaaacacacataactaaatttaccatcttcttcttcaccaggctgctataatattggctactaacagtgttcaccttttctgtggaattgccattggctaaacaggatctgtcagcttggggccagtgatggattagcaagggaggagtgtatcaaaggactttaaggtggcaccaatgttggggtgccatctttcctccagagctctccatggaaccaggctgaagcttatgtcaggctaacacctcatctttactcaactttcttctgcttgatcatgctttcttaacttcccttctcttgagagcagagcccagtaaaatattttcacaataatcctcatgagcagtaataaatagttactgtcttctttgtttttgtttttgttttgtttggggttttctgagacagggtttcctaggctggaatgcagtggcatgatcacagctcactgcagccttgaccttctggactcaatcgatcctcccacctcagcctccctagtaactgggactacaggcatgtgccaccatgccctggtaatttttatattttttgtagagacaggttcttactatgttgcctaggctgctctcaaactcctagactcaagcgatccactcacctcagcctctcaaagtgctgggattataggcatgagacaccacacccagccaatggttgttgttgtaagccactgaattttgaggtgttttgttacaaagcattataaactgacacaattagaacacatgaaatatgaaatactatccagccattaaaaatgatgggagccctatgtattgactacaaaacatgtcaacaggcagttttctgggggaaaaaaatgatcacaggaaagttttatagcagcattcttttttttttttttttttttttttttgagatggaatctcactctgtcacccaggctagagtagagcagcacaatctcggctcactgcaacctctgcctccaggtaaaagtgattcttgtgccttagcctcctgagtagctgggattataggcatgcaccaccacgcccagctaatttttgtatttttagtagaaacggggtttaaccatgttggccaggctggtctcaaactcctaacttcaagtgatccacccacctcggcctcccaaagttctggaattacaggcgtgagccactggcatccggcctatagcagcattctttttgttaaagaaagttaacacatgcttccatgtggatattcagtgtctagcagggtcttcaaaggatgaacagtgtttagtccctgtgtggtgggactatggacaacatattacttctatctttgcatttattttatataatttcatgtttaaatggaacttcggttttatttgaattaaagttgtttaaacaaaaaaacaaaaaaaaattttttttttttgagacagagtcttgctctttcgcccgggctggattgtagtggtgcaatctcagctcactgcaacctccgcttcccgagttcaagtgattctcctgcctcagcctcctgagtagctgagattacaggtgtgtgccaccacacctggctaaattttttgtatttttagtagaggtgggatttcaccgtgttggtcaggctggtctcgaactcctgacctcaaataatccacctgcctctgcctcccaaagtgctgggattacaggcctaagccactacacccagccacagtttctaagtgtatagttcagtagcgctaagtatattcacactgttgtgcaacaaatctctagaactctttatcttacaaaactgaacctctatacccattaaacagccccttattccttacaggctttgctgatgaaaatccattctttgtttcattcagtgtacatttgtcacacacctcctacatcccaggcattcttgtaggcctcggggatatagcagtggataacacagacaccatccctacccacctatcacttgctttcttgtcaaggagatgggcaataaaacaaacagatacataacagaaaccaagttagaagataagtactatgaaaataacaagaagagctagtcatattgagtcctcactaggtaccaggcattatttgaagtgttttaagtgaattatttggtttaatactcaccacagtcctaagaagcagttagtattattataatccccttttgacagaattaaaagaaacaggagggaaaaaaaagattaagcaatttgccagtcacacaagtggggaccagcaaagctgggatttgagccccagaagtctgactctggcactcccctgccaaacaattagccatgccgtcttgcacttattcatttactaatgtttgtgaagtgcctattctgtgccaagccctagagatctgtgtcagtgaaggaaacaggcaaaaatctctgcccttcatgatcttccatccaatcaagtgtgggaaggcagacattaagaaaattcaaagattaaattatgtggtatattgtaatactgcaaggggacagtctgtggagaataataaaaggaagtcacaggcacaggtgctgcctttttctttttttttttttttccgagatagaatcttaccctgttgcccaggctggagtgcagtggcgcaatctcggctcactgcaacctccacctcctgggttcaagtgattctcctgcctcagcctctggagtagctaggactacaggtgtgcaccactatgcctggctaatttttgtatttttggtagagatggggtttcaccatgttggccaggctggtctcgaactcctgacctcaagtgatccacccgcctcagcctcccaaagtgctgggattacaggcgtgagccactgtgcccggccagggctgctcttttaagttggtcaggttgctacttaggatgttccaggagggcctctctgtggaggtggcttttaaagagacttgaaggagatgagggaatcattcatgcaagtcctgagagaacagcattccagaaggagagaacaaacaaaggcaaagacccagaggcaggaacatgcctggtgtgttcagggaataacaaggaagcctgcatggctggaacaaagtgatcaagaagataacgaaaagaaatgaggtcaaaaatagtgcaggacaatttatgaagttttagggccaaagaaaatgactttgatacatggagaagccttaaatgtacattactaattaaaggaagccagtctgaacagactacacactgtatgattccaactatatgacattctggaaaaggcaaagctatagagacagtaaaaagatcagtggttgccaggggttcgggagggagggagaattaggtggagctcaggggatttttaggaaactcctctgtatgatactgtcacggtggatacatgacattacgcatttgacaaagcccatacaatgcacaacacaaagcatgaaccctaatgtaaactatgaactctagttaataataatgcatcaatattggcttatcaattgtaacaaatgtaccacactaatgcaagatgtacgtaatagaagatgtggggagggaaagtggaaattggtatacgggaactctattttccactcaatctttccataaatttaaaactactccaagccatgaaatctattaatttttttaaaggactggattttctgtgagtgagatggggagacatttgaggccaggaagcagactgacaatggactttgctctaacaggatcctctggaggatcctgctatgcagagagtacactgaaggggccaagactggggcagggagacaaggaggagctgttgaaatagtccaggcaagagacaagggtgttttggaccatggtggttactgtcaccaggtcagaagtggcatggatagagccaacaggattttctgaaggaatagagggttagaggttagggtggaagcccccacccgcagtggcctgtggcttacccaaggcaaaatgaacacgtacttatggtgcccagacaaagtggaaaatagcctggatgaatttatctctaattgcatatttaaaagggctattaaaaagcttttttaatttccacatgcatgtgagctttgaggttttgagttcattattgtttttactctgaactgcatatgaacaggggctcttccatctctcagtgcattggacctctagaggtcccaataccacactgcctaaggggtacaatccaggaaaagccaccacagtcaccatcatggctgaggaggggccatgagtggttgattgtctcatcctgaatgcagaaggcttccacacaggtctgtgcccaagaagtcaaggttctggggtctctgtgagcccctaacagtcatctggtccaaccctgcattgtacacgtgaagtaactgaatcccaagaggtgcaagtcactctcccaagttccctcagccaggtaaaggccagagttggggcctcctgatgcccagatgagagctctgtcctcctgcaatttgctgtgttcatttcctgtggctgccataataaaataccacaacctggtggcttaaaacagaaatttcttccctcacagttttagaggccaggagtctgaaaccaaggtgttggttagggtcccactccctgcagaggctgtagagaaggatctcttcctcacctcttccagttcatggtggctgcaggagttcctaagcttgtggctgaatcactctgatttctgttttcatattctcttctcctccctgtgtctctcctcagggtatcccttatggacacttgtcattggatttggggcccacccagataatccaggatgatctcatctcaagatccttaataatatctgcaaagatccttttttcaaataaggtcacattcacaggttccagggattttacatggatatcttgttggggaggtaggtcatttttcaggctatggttgtcaatgcccataacatggattaagctctctagctgccagtagccacccacatcacaggagggagagaatggctcatgtgcccccaaagacctagcctcagagcagtgagacccgggctccttcctcacaactgaatgtgtggtacacagattcttgggtggccccatgatcccccctcttaatgttaaggactttgtgtgatcttatccccttgagtgtgggcaggactctgccttgcttctaaccaacaggatacagcaacggtaatggtatatgtgtgattgcatgtgcatgactgtgttgcatcagattgtaatgcctatcttcctaagagactctctcccctgtgggatttgaagaacaaggctgccatgttatgtgctgcctatggagagggccacatggcaaggaattaaagtaacctgtagatgacagccagcaaaggggccagcaagaaactgggccctcagtaagcagcctgcaaggaactgaatgttgccaacaaacacatgaacccagaagtgcatccatccccagtcaagcttcacatgagaccacagccctaaccaaccccttgattgcagctttgtgagaccccagtgtaaagggcccagctaggccatgccctgactcctgacccagagaaactctgagataataaatgtattgttttaaactactaagtgtgtaataatattataatagagcaacagataactaatgtggaacctatcatggtctccccaagccaactccttcagatgattgccattccactcacccatatgccaaaaacctgggtatcacctggggctctttctcctcctctcagcattccccctccacatccaatccatcagcaagtcttggcaagtcttccttctaaatgtcttcctgtctcatggaaaattaccttgatgcaatggtgacccctaagaacaccatcaggtaactaaatcagaggccatggaactgaaaacctcacagactaaattgagatgctcaactcacaccattcattaaccaattaaaacccaaagtcaaacaaaatcaaggaggcagggcatggtgactcatacctgtaatgtcaacactttgggaggctgaggcagaaagatcacttgagtccaggagttcaaggccagcctaggcaacatagtagagaccctttctctacaaaaaaaaaagaaaaattagccaggtatggtggcacatacctgtagtcccagctactcagaaggctaaggtgggaagattacttaagcctgggaaattgaggctgcagtgggctatgatcacaccactccactccagactgagtgaaagagcaagaccctgtttcaaaaaaaatcaagaaaaaaatgataaggttggttggctcatttagaattgggtacacacaagtaagtggaaggaacaaatgatcctggatccctggggtatgcaacattcatgtgtcctgtttctctctctccctctctttctttgtccccctccccatacacacacacacacacacacacacacacacaccagcctgccctgctgaagtatggatttggaggagcagtgttgaggtttgagcaagggagcatccaacagataaagatgcccggggccaatcacacacaactctactggactggagagacctagaaaaatacacagtcttggccactgctgtagtttgatcactagcctgccatacagccaagggctttatctgcatttcttggatggaacatacgtagggccagaatgagactaggattggtgactccagtgggtggccaatttagggacgacctagctgtcagactagcagtgacaccatcacaacttggtcttttcacccatttctatttacaacactcttatttgttttgccatagaagtcatttaatctatctatgattagtaagttactaacattcttactatctatcaacacatttaacataccttatgaattctgcctgagttgtgtatgcttaacacttcctctaaattttgtctctatttcataagctcctagcttatgaaccatctatgctgaacacttcttaggaggttcatccatcctatttgcttttcttatcctttataaaagaattacatattatcatgtaatgcagcaaacgcgtgttacacttcccaaaccatccactttcttgcaactcctctgcctccaccacagtccaagctgccactttctttcaactgcaacctcttaattggtttcctgctactacactgaccatccccacagtatccggaaggtggcttctaaaagggaaatctctttctgtccagcctggccataaagcataaactcctgaatgacattaaagcctatgatgatacagtcacaacgccctctcctctcacttcaagtcccgctattgcccacctcccacaccatgcactctcagaaccagccctgcctctgcacatgccctgcctagaatgagctctttccaatgttcctgctcaactcctacactccaatcaagacccagctcaggcatcacctcctctgggagccattctctgattctctccccagtaaatattcagggaggagacaggcaaggagaagagaggacgaagagagagaaggaagaatggaggaaagccataaccattccactattaaatggaataaatccagaagtaataattgccctccccctcaaggtatttaaataagactgaatgacatctaggaaaaataattgcagaaattgttcaaacacagaatatgcacttgcaccagaaacaatccacaatttttccttggagtccgggtgttccaattatcttttggggcaaagtaaatgaccccagtgcttactggcttaaaacaacaaccatttattatgtctcatgatttttaggccatttttctcctctgtggcactgactatgctcactcagtggtatttagccagcagctgggctgggctgaagtgttcaagacagcatcattcacatatgtgccttttggcaggagccaggagtctaggctcagctgggtgtctcccctctgcatgtagactctggtctgtccagcatatccaacagcatggtcagacatcacatgcggcatctcaggctccaggagaccaaagtagaagcggccagtctttttaaaaacggccgagtgctgtggctcatgcctataatcccagcactttgggaggccgaggtgggtagatcacaaagtcaagagatcaaggccatcctggccaacatgatgaaacctcatctctaataaaaatacaaaaattagctgggcatggtggcacacacctgttgtcccagctactcgggaggccgaagctggagaatagcttgatcccgagaagcggaggttgcaatgagccgagatcgcaccactgcactccagcctaggcgacagagtgagactctgtcttgaaaagaaaaaaaaaaaaaaggcccagaactggcatggcatcccttcttcaacactctattggtcaaaacatttaggggccagcccagcttcaaggaagaggggaaacagaccccacctcttaatgaggactgtcaaaaaatctgcagccatctgtaaattcctgatgtggaactgaagaccacatctccagaaagcctcaccaggcctgggaacagtccagacaaaacagccactgaacccctgacaacagtaactatgagataatatatgttttttgttagttaaacccatttcatttggggataatttttttttttaatggagtccctttctgccacccaggctggagtgcagtggcgcaatctcgtctcactgcaacctccaccacccaggttccagtgattctccagcctcagcctcccaagtagctgggattacaggtacccgccacaatgcccagctaacttttgtatttttagcagagatgggggtttcgccatgttggccaggctggtctcgaactccttgtgtccggaattggtaggttcttggtctcactgacttcaagaatgaagctgcggaccctcgcggtgagtgttacagctcttaaggtggcgcgtcgggagtctgtcccttctgatgttcagatgggttcagagtttcttccttctggtgggttcgtggtctcgctggctcaggagtgaagctgcagaccttcgcggttagtgttacagctcttaaagcagcgtgtctggagttgttcgttcctcctggtgggcttgtggtctcgctgggctcaggagtgaagctgcagatcttcgcgataaatgttacagctcataaaggcagcatggacccaaagagtgagcactagcaagatttattgcaaagagcaaaagagcaaagcttccacagtgtggaaggggacccgagtgggttgccaatgctggctcgagttgccaatgctggctcgggcagcctgcttttattctcttatccggctccacccacatcctgctgattggtagagccaagcggcctgttttgtcagggtgctgattggtgcgtttacaatccctgagctagatacaaaggttctccacgtccccatcagattagttagatacagagtttcgacacacaggttctccaaggccccaccagagcagctagatacagagtgtcgattggtgcactcacaaaccttgagctaaacaccgggtgctgattggtgtgtttacaaaccttgagctagatacagagtgccgattggtgtatttacaatccctgagctagacataaaggttctccaaggccccaccagagcagctagatacagagtgtcgattggtgcactcacaaaccttgagctagacacagggtgctgattggtgtgtttacaaaccccaagctagatataaagactctccatgtcctcaccagactcaggagcccagctggcttcacctagtggatcccgcactggggctgcaggtggagctgcctgccagtcccgtgccatgcgctcgcattcctcagcccttgggtggttgatgggactgggcaccgtggagcagggggtggtgctcgtcagggaggctcggaccgcacaggagcccatggagtgggtgggaggctcaggcatggcaggctgcaagtcccaagcccttccccgagggaaggcagctaaggcccggcgagaaatcgagcacagcgccggtgggctggcactactggggaacccagtacaccctccacagccactggcccaggtgctaagtccctcattgcctggggccagcagggctggccggctgctccgagtgcggggcccgccaagcccacgcccacccggaactccagctggcccgcaagcgccgcacgcaggcctggttcccgctcgcgcctctccctccacacctccctgcaagctgagggagcgggctccagccttggccagcccagaaagtggctcccacagtgcagtcggggggctgaagggctcctcaaatgccgctaaagtgggagcccaggcaggggaggtgccaagagcaagcaagggctctgaggactgccagcatgctgtcacctctcaatcccccctctaaacaggacaccccaactgctgttgggaatttggctgatgaccgctctagctacttcctgctgcataggggcgaaggaggggccctgcacttgtggtgtccttctgagggaactcagcttgcagggaggtgtggagggagaggcgcgagcgggaaccagggctgcgtgcggagcttgcgggccagctggagttccgcgtgggcgtgggcttggcgggccccgcactcggagcagcccaccagccctgctggccccgggcaatgagggacttagcacccgggccagtggatgcggagggtgtactgggtcccccagcagtgccggcccaccggcgctgtgctcgatttctccccaggccgtagctgccctcccgcggcgcagggctccagacctgcagcccgccatgcctgagcctcccacccactccatgggctcctgtgtggcccgagcctccccaacaagcaccaccccctactccatggcgcccagttccatcgaccacccaagggctgaggaatgcaagcacatggcgcgggaccggcaggcagctccacctgcagccccagtgcgggatccactaggtgaagccagctgggctcctgagtctggtggggatgcggagagtctttatatctagctcagggattgtaaatacaccaatcaccaccctgtgtttagctcaaggtttgtgaatgcaccaatcgacaccctgtatctagctgctctggtggggccttggagaacctgtgtatccaaactctgtatctaactaatctgatggggacgtggagaacctttgtatctagctcagggattgtaaacgcaccaatcagcaccctgacaaaacagggcactcggctctaccaatcagcaggatgtgggtggggccagataaaagaataaaagcaggctgcccgaaccaccattggcaacctgtttaggtcttcttccacactgtggaaggtctgttcttttgctctttgcaataaatcttgctagtggtcactctttgggtccgcgctgccttaagagctgtaacactcaccgcaaaggtctgcagcttcactcctgagcccagcgagaccacgagcccaccgggaggaacgaacaactccagacgcgctaccataagagctgtaacactaaccgcgaaggtctgcagcttcactcctgagccagcgagaccacgaacccaccagaaggaagaaactccgaacccatccgaacatcagaagggacagactccagacgcgccaccttaaaagctgtaacactcaccgcgagagtccacggcttcattcttgaagtcagtgagaccaagaacccaccaattctggacacatcctgacttcaggtgatccacctgcctcggcctcccaaagtgctgggattacaggcatgagccacggtggctccctgaggataattacatagctgtagatgccaaatacattcaccctttccaaagctgtccttccatccatattcaagacagtgtcctggaagggaaacatccagggacaggatgtgtgatggatttcaggataagagcctaaagttaaagaatttaagaaagttatgagaccagatcttcaaaatctactatctcggagccaattctcattcatatacgcacgtaacaaatatctctgagttcctactctgtgctgcgcgttaagcaaagtgctggagatagaagggtaagcaaaacagacatggtctctcaaatcacaggtctctttaagaataccccagtctgggtcctttctatatcctgtaagtttcactcccagggcagctactgccggatgaaaatgggctctgggccaggcctgtaatcccagcactttgtgagggtgaggcaggcagatcacctaagctcaggagtttgagaccagcctgcccaacatggtgaaaccctgtctctactaaaaatacaaaaaattagctgggcgtggtggtgggcacctgtaatcccagctactcaggaggctgaggcaggagaatctctttaaacagggatgcagaggttgcagtgagccgagatcacgccactgcactgcagcgtgggagacaacagcaaaactccgtcaaaaaaaaaaaaaaaagaaagaaaagaaaatgggctctgggcacctctaataattcacagcccctgtccctagcccagcctgctcactagtcttgctttccttcttggcttctgacttggctcatttcatgttacccattgcttggacctaatacgctggctttgggcttttctagcaaaccacattcccattcactttcacgttccaaaccagggccaggcacagtagccgcgaccttagcatcggccctaggagtgacccggaagtccatgccaccagtccagaagtcattccggactcttctttcctgtgtctcccggtccagttcttccttccgctgaacgctgagaaagtcgtccctgggcgggggaagctggctctttgcttcccctcgggcccatgagccattgtccccaaccagcgaggcgcatcttagaagcaccatctcctcgggctcttttcctgctctgcctggattgggctcatttactaaaaattagttgggaatgaaaaaagcccttagtttattagcgtgctattattcccctcccaccatgcccctgcagcatgatggattgcctggtgaggggacgcagccccagccggggagtgagcaagctctgctcggtccccggcgcagacagatggggaggccgagtcctgaccatgattgattagctccgcaaagcctgttgagcggagttccatcaagattgatgctttctcctcataacagcatttccaaaaagtttctattacattttgattatgtttatagaatctcgctggtccgggggaagatgcaatctcgttcgttcccagtatgtgtctgcgtgggccgccacagcgcctcacacagccctgctagcttggcctttgcagagtgacctcactttctggtcaggaggaaggacttgggttgcctcccaccatcaaggtggaagaagctaatgtccactctcccagtgcccagagttcagtctcacggcagttctggttttcgaagcccaaccatttcaggtgttctcaggcctgggcctgaaggtaaaagagaaaatcagagcaaaggcatttcctgagatcggcaggctgttgcggaagagactgggcagccctcatttttctacgtggttcccaaggacacagtaagaccacgtcaaatgcgtggcaaaatatatgtttaaatatttatgcaaatgcatttatttatgtgtgtctgtgtgcgtgtgtcccattttaccccacaaaggatttgaatgatgtacaagaaatgtggaaaatgaataaagaacaagaattcggaccagggaaatgcaaatcaggctagaatatcaagaccaaaaggaaaaactaaatatatatgcaacatgtaagatgccacagtctttatgcttgggcctttaagttggtctgagtttcctgatagtcaacgtgaaaagggaaataaaattggttacttagttcttttctagctgttattaataaaagaattttcagaaatgccagttctttgggggaatcttagggtttcttccaattttattctaaaggaaattttgtactagagagttgtaaatagaagactacaataaatatgttaaaccagtactgacattttgggctagataattccttgtgtgggggctgccctatgaatcataagatatttagcagcatccttagtctatactaaccagataccaatagcgaaccctcttcaagttgtaataaccaaaaatgcctccagatactgtcagatgtatcctggggtttgctattgctagatttaacaagaattcagaatgcccagttaaatttgaatttcacattttttaaaatgaataatattttaatgtaagtatttcccaggcaacatttggatatacttatactaaaattatattcttttttatctgaaattcagatgtaactagccatcctggattatgtcaagtaaccccacctgatgggccacatcctcagtgggaagatctcccaggaacctttcaaacatgatgcactgcaaggggcttactctccacatcatgttttttaaagtgtaacaatgtgaaaacatgtttttcttcagtgcttctttttttatttatagataacaatagtttgccttctgttttatatctttttaactataaaatttaattgtgatctatcttgcaaataaatgatatacttttgaaaaaataaataaataaaaatttaaaactccaggccttttgcagtggctcacacctataatcccagcactttgggaggccaaggcacaaggatggtttgacctcaggaattcaagaccagcctgggcgacagagtgagaccccatctctacaaaaaaaaaaaaaaaaaaaaatctaattgagcaccactatgttaaacagtgccctcaaaacagccctttggggtaataatgtagccagagaattccataagactgggtcttgtagtatccacagaagaaatcaagggcataactctacaatataactttaaaagagcaattctgcacagttctaaacaatattatccttccacaatatttttgacgatcctgcttgatccagtgttaaaacctagagacactttgctgcaacctccccctagtctaactgcccagattccctttgcaaaaggcagtgaggtgagtctcacctgatggtcccaaatgatcccatgctggtgctgctagtttcctttggccactgggattacaaagtagactcaagcaatctctagaaattacccattctagggttactcggttgtaaaaactggctagacatttggaaaatagcagttggatcccttcctcatcctttgtaccaaaataaataccagatgtatcaaaatttttaagcatgaaacaatgaaatcagattagtactagaagaaaatgtgggataactttttggaattgccaggataggaaagggccttttgtgtcaccttcgggacacaaaatccagaaacgatggagtaaaaaaagattgagagattttaccacattttttaaatgtaagtctctgcatggcagacagaaaaacgaagactaacgaagttggggaaaaatacaggccatataaaggaggactaatgtctccattacacagaaagttcccagaaaaagaaattcaaatggcttttaaaaacatgaaagagtgatcaacctcactcagctacaaattaaaaccacaattaaaaatctatttttatcaatcatatgggcaaagatcaaaacgtctaataacatgccatcagtaagaatggggggaaacagacactaaaagagttgttggaaatacatgctcactcttggaaggcattttggcattgtgtattcaattttagctgtgcagtttcacttctgatatttactccacagatatgtatgagtgcaaagatgtatatataaagttagtcattaaagtgtttgttagcaaaatttgtgaataaactaaatatccaccactacaaattttcttaaataaattatggtacattcatgcaaagaaatgctatgcagcagttttacaatatagagtggctatagaacaagaagtagtaaggaatgatctccaagatataatgtgaagtgaaaaaaaagaaagtgctgaagatgtatagaggatagtaagacaaagtagatagatatataaacgtgcttttcttattcatatatgtgtgcttatgaagcaatacacaagaaattggttatattgattgcctctgggaagtgaacataagaaactggtatgaagaatgaaaacaagatttacttttaacgaatacttttttgaatcatttggattgttttaaccatgtgtatgtattaacttttcaaaatgacatcaactgatctttgacaagagcaccaagaatacacaatgaggaaaagattatctttccaataaatggtgttgggaagacaggatatccatgtgtcaaaggatgaaattggacccctattttataccataaaaaataaactcaaaatgaattaaagatttaaacataaagacttgaaattgtaaaactactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggaggggggagggatagctttaggagatatacctaatgctaaatgacgagttaatgggtgcagcacaccagcatggcacatgtatacatatgtaactaacctgcacattgtgcacatgtaccctaaaacttaaagtataataataataaaataaaaattaaaaaaaaaaaaaactagaagaaaacatagggggaaagcttcatgacattggtcttggcaatgacttcatggctatgacaccaaaagcgcaggcaacaaaagcaaaaatagaaaagttggactacatcacatttaaaacttctgcccagtaaaggaaacaaccaatggagtgaaaaagcaatctatggaataggagactatatttccaagccatatatccgagaaggggtttatttccaaaatatataaagaactcttataactcaacagaaaaaaaatagtacaactgaaaaatgagcagcagccgggtgcggtggttcacgcctgtaatcccagtaatttgggaggctgaggagggcagatcatgaggtcaggagatcaagaccatcctggccaacatggtaaaaccccgtctctattaaaatacaaaaaaaaaaaaaattagccaggcatggtggcgcgtacccgtagtcccagctactcaggaggttgaggcaggagaatcgcttgaactcaagaagcagaggtttcagtgagccgagattgcaccactgcactccagcctggcaacagagtgagactccatcaaaaaaaaaaaaaaaaggtaaaggacttgaacagacatttctctcaagaagaaatacaaatggccaacaggtatatgaaaaggtgctcaacatcactaagcattaggaaaatacagactaaaaccacaatgagatatcacttgacacctgttacaatggctattatccaaaaaattgaaaaaatagcaagtattgacaaaattgtggagaaattgggcccttgcactctatcggtgggaatgtaaaaaacaatttttaaatttaaaaatgcccagcttaacttaaaataatttatcttatggaaataaccagacagttgctaacatttgtactccaaaatatttattgcaatatcgtaataaaaaattggagatgacttcagtgtccaataatagacaattggtttaaatgatatatgatatatacatgcagtaagaccactttgtaaccattaagaatcaccgtcataaagaatgatttaggggccaagcatgatggctcacacttataatcccagcaccttggaaggctgaggtgggaggaccactggagcctaggatttctagaacagcctgggcaacataatgagattacaactctacacaaaattttaaaattagccaagcatagtgttgcatgcttgtagtcccagctacttgggaggctgggatgggaggattgattgaccctggaaggatgaggctacagtgagccacgattgcaccactgcactccagtctgggcaacagagcaagattctgtctcaaaaaaaaaaaaagggaatgacttaggatatgagaaaatgatcatgatatattattaagtgaaaaaaaacaagcacaaaatcatatgtacaatatgatcatgattgttttcaaacacacacagagatgtttatgggataggagagatgttttccaaatgttagtagccatgttctctgggtggcagatttgcaggtaatgtgtattctcttcttcatacttttctatatagtccataatttctgtgaaaaaatattaattttataattaaaaagcattcaatattatatgaaagggaaataaattcccactggccctatgctgagatgaatgccaagttcctagtccctccatgacgcttagggtcagctttatttttttaaaaaaaaagggctagggctagattccagtggggggactatttgggacacagcataattttggctataagagtcagtgatcccaattggaaggccatatttcagtcccataggatccacatgataaagaacatggagggcagaggtcctgaatccttgatactacctggaattctttctacctatttttggctaaaaccactctttatttccagcaaaagcctctacgacctcctccaaatccaccaaaccttcaaagcctgccacatccaggaagccctgtctgataccatcccctctgccgacataggacatagtgtggacatctctccccagcccctagttatttactatactgtaaaaatattttaaaattattaatcacagctgtggctgggcacggtgactcacacctgtaacctgtaaccccagcactttgggaggccaaggcagccagatcacgtaacgtcaggagtttgagaccaacctgggcaacatggtaaaaccccatctctactaaaaaacaaaaattagccaggtgtgatggcaggagcctgcaatcctagctactcaggaggctgagacaggagaattgcttgaacccaggaggtggaggttgcagtaagccaagattgcaccattgcactccagcctgggggataagagcaaatttccctctcaaaaaataataataatacaataaaataaaagtattaatcacagctaccatttactcagcacctcattttgcaccacatgctatgcaaaactctttacatttattaggtcattcaacctttataacaaccctacgatgaagcctctataaagtgtatagttgagcaaaatgaggcacagtgggacctagttcctcacttagggtatctcaaacagtaatggcactaccaggatgcaaactaagttcagtgatttcaaagaccataacctcaactactatgagatgctgactctttcatggtgtgcctctcagaatcagagatatttttctactggacaggccctgccaagtacccatttctcttgacagcagcaaccaaacttgccttgggaaatcgtcctctttttgtgcaatatttccgggactgtcattcaagatgtcccacctgtcctggtcacatgaccccacctgagccaatcaggcttattgtcagaactttgagcctagaataggtgatgcaagaacagaaaggtcagtggacccttgagccaattggtcattaacccatgattaactggactctatccccagaaccaaacctattgacctcacatgctgcaaaaaattcctggttttgtttagattaaccagagtttgctcagtttagcttggaatcaaaaaccctacctaaaaggactagtgtctgaagtatataaaggactctcaaaattcaaccataaaaaacaaaaattttcaacaaaatactagcaaaccaaattcagcaacatgtaaccaagtgacatttatctcagaaatgcaagattggcttaatgtacaaaaatcaatcagtgtaatacaccatattagtagaataaaggacaaaaatcacatgatggtcttaatagatacagaaaaggcatttgacaaatccagtaccttattatgatttttaaaaaaatacttcacaaattagaaatacaagagaactttctcaacctgataaaggccatctattttttttaataatccacagctaacaatatatttaatgatacttaatggtgaaagattggctggctttctcctaagatcaggaataaaataagaatttccactcttgccacttctgttcaacattgttctacaggttctagccagagcaattagacaagaaaaaaaaagacatccagattgggaaggaagaagtaaaactatctccattcacaaatgacatgatcttatgtagagagaaaattctaaggagtccgctaaagaaattgttagaggctggccacagtggctcatgcctgtaatcccagcactttgggaggccaaggtgggaggatcatctgagtccaggagttcaagaccagcctggcaacatagtgagacccccccacacacaagaaataaacaaaattggccaggtgtggtggtgcatgcctctagtctcagctaattgggaggctgaggtgggaggatcaattgagcctgggagccaaagtggcaataagccaagattacacccttgcactctggcccagatgacagagtgagaccttgtctcaaaaaaaaagaaaaagaaaaagaaaagaaagaaagaaactgttagaactaattaaggagttcagcaatcttgcaggttacaagatcaggatacaaaaatcaactgtatttctacacacttgaaatgtatggtccaaaaatgaaattaagaaaacaatttcttttacaatagcatcaaaaagaataaaatacttaagaataaatttgacaagagaagttacaccaaaaaccacaaaacatcattgaaaaaaagatgtaaataaatggaaagatgtaaaaaaaaaatggaaagatacctgacattcatgtattataagaagtaatattgttaagatgacaatactcctcatattgatctctggaatcaatgtaatttctatcaaagtctcagttgtctttttgcagaacttgacaagatgattctaaaaaaataaacatggaaatgcaagaataggcaaaacaatcttgaaaaagaagaacaaaactggaggactcacatctcaatttcaaaacttactatacagttacaataatcaggacattatggatctaacataaggatagaaatatagaccaatgaaatggattctgaaattaagaaataaactctcacattatggtcaactcattttcctgaagggtaccatgacaattcaatgggaaaagaatagccttttccaaaaatggtgctgggataactggatatccacatgcaaaagaatgaaattgggcccctacctcacaccacgtgaaaattaattcaaaatcaattagagacctaaatgtaaaagctaaattcataagagtcttatagaaaacataaggaacaaattgtgtccttggattaggcaatggtttcttaaatataacaccaaaaacccaaacaacaaaagaaaaataaattggagttcatcaaaattttaaacttttggccaggcatggtggttcatacctataatcccagcactttaggaggccaaggtgggtagatcatgaggtcaggagttcaagaccagcctgggcaacatggtgaaaccccatatctactaaaaatacaaaaattagctggtcgtgatggtgggcacctgtaattttagctactcaggaggctgaggcaggagaattgcttgaactctggaggcagaggttgcagtgagccaagattgtaccactgtactccagtctcggtgacagagtgagactcagtatcaaaaaataaaataaaataaaacttttgcacatcaaaggacactataattaaagcaaaaaaatccccataagatgggagaaaatgtttgcaaatcatgtatctgacaaggagcttgtatttagaatgtataaagaacacttacaaattgaacccccaaaagccaaataagccaatctaaaaccaggcaacgaatttgaatagacatttctctaatatatgcaaatggccaataagcacatgagaagatgctcagcatcattagtcattaaagaaatgaaaaccaaaactacaatgaaatactacttcgtaaccactaggatgactataatcgaaaatgtgaaaaacaacaaatgttagcaaggctctggagaaattggaaccctcatacattgctggtaggaatgtaaaatggtgcagccactctagaaaatattttggcaattcctcaaaacatatggttatcataagacccagtaattccactcctaggtatataagcaaaagaattgaaaacacaaaaatttggccaggcacagtggctcacacctgtaatcccagcactttgggaggccaaggatggtggatcacctgaggtcaggagttcaagaccagcctggccaacatggtgaaaccccatctctactaaaaatattttttttaaaaattagccgggcatggtggcaggcacctgtaatcccagctactcaggaggctgaggcaggagaatcacttgaacgtgagaggcagatgttggagtgagccaagatcatgccattgcactccagcctggggacaagagcgagactttgtctcaaaaaaaaaaaaaaaaaaagagaacccaaaaatttaaacataaatgttcatagcagcattattcataatagccaaaaagtggaaacaatataaatgtctactcactggtgaatagatcaacgaaatatggtatagccacataatagaatattcattcatcaaatgggatgaagttctgaaacatgctacaacatggatgaaactcagtgaagaaaagcagatacaaaaggtcatgtattgtatgattccatttatatgaaatgcccagaacaggcaaatccacagagacagacaatagatttgcagttgccaggggctgcagaaagagagggatggaatttgactactagtgagtatgaggcttcattctggagtgacaagatgttctgaaattagatagtgatgatagatgcacaacttgctgaatatactaaaaaccactcagtcatacactttaaaagttcatacatgaactttatggtatgtaaattatatctcaataaagctgtaatttaaaaaaaaagagggagagactgctcgaaaaaataaaaaacctcaccagtaaaaaagtaaacaatcaaattaaaaaataggcaaaaaacacagagagacatttcgccatggagtacatatgggtggcaaataagcacatgaaacaatgttcaatatcactagccactggaaaatgcaaatttaaaacacaatgagatatcactacacacttatgagagtgactaaaataaaaaatagtggcaacaccaaatgctggcaaagacgcagagaaactggatcactcacatattactaatgggaagataagatggcacatccactctggaaaacagtttagcggcctgttataaaaactaaacatactgccaggcacggtggctcacacctgtaatcccagcactctgggattacagcaatcttgcacgttacaatatccgccaaggagggtggatcacttgaggccaggaggtcgagaccagcctggccaacaaggtgaaagcccgcctctactgaaaatataaaattagccgagtgtggtgacgagcacctgtagtcccagctactcgtgccacttcactccagtctgggtgacagaataagactgcacctcaaaaaaaaaaaaaatacaatgaccatacgacccagcaattacactcttaggtatttatcccagaaaaatgaaactttatgttcacatataagtaaaactgtataaaaacctgtacttgaatgttcatagtagctttattagtaatagtcaaaaactggaaacaacctggatgtacatcaatagataaatggttaaacaagctctggtatatctgtaccatgcaatagtacttagcaataaaaaaggaattaattattaataaacacaacctcaatgaagctccagataattatgctaagtaaataaagccaatcccaaaaggttataactgtacaattctatttatataggatttttgaaaagacaaaattttagaaatggagagcagattagtgggggctggagagcaggagggaggtgggtgttggtattagagggcaacatgagagatcctcatggaaatacaactcttatgtataatattttgactgcagtagtggatacacgaacccatacatgtaataaaatggtatataaccaagtacccacacacacaaacacaagtaaagctggggaaatattaacaagtgctttgtattgtatcaatgtcaatatcctaattgtgatattgtattaagtttaataagatgttaccactgggggaatatgggtaaaggatacacagggtctctgttactttttacaactacatatgattcaacaattgtctcaaaataaagtttaattttaaaaacctctacctggctggctggctgggtgtggtggctcacacctgtaatcccagcactctgggaggccaaggcgggcggatcatgtggtcaggagttcaagaccagcctgaccaacatggtgaagccccgtctctactaaaaatacaaaaattagccgggcttggcggtgggtgcctgtaatcccagctactcaggaggctgaggcaagagaatcacttgaacccaggaggcagaggttgcagtgagccaagattgcaccattgcactccagcttgtgcgacagagcaagattctgtctcaaaaaacaaaaaacaaacaaacaaacaaaaacctaccttatatatgatagaaagaaggaagggagggatggaggaaagaaaagtaaattcatttactatggatttaccttgtttcagaatccaggctctttaacatgtggctggagataaatattatcatccccattttatagatgatgaaactgagtctcagagaataactgtctcattctcaaagatatcctttgagaagtcaagagtcaagccctgctctctgtcagtctgctgtcatgctttagccaaacacagccatcaatcaaatgtaggcaaagactgctttactcaagaggaaattgaagccagactgtaagatgcagtccacaaaattcatgatttcttcccccaccccggctccatctacttggtccctttttcatatggattgggtttttatttctgcatttattgcacacacaaattacagatgagagcatcgactacacaagtcattactcagagtagcatcttcccaactgccactggactaggaccgaacagcttgtggttaatttgctatataatcactgcctgtgacggggggcagggctgagcctgtgctaatattaggaaaagggaagctgagtagagaggactcctggggcatgaagagtgagggtggtatcaaaccagggaaaaaggaagagtgctggtggggagcaggaggagggggccctaccccactgagagactccaagaaggatctgctcctctgccaaggaatagaagtgctccgtcccattcatcacgtctgcatggaagagctaaccagaatcccaattctcctaacccctgccatttcctggccgctgccactgctgcctcctcacctcagagcagggatatttgtataccacgctgcatctgctgggagggacacttatagaatggttcatgggcaggaggaaacttaccaacaggcgggagttacagccaccatactagcgttctaataactcaatatgaaaaatggccaacaatccaataaaaaatgggcaaaggatgtgaacaggcttaggaaacttaacctctaaatagacaaaaagacgttcaaccttcatcttaataaaatgtaaatgtcaattaaaactacaatgaaatacctttatttttacctatcggattgacaaagatcaaaatgtttgatcacacactgtgctggccagactgtagaaaaaccagcagtcccaaaggttggtgggagtgtaaattggcacagttttcatggatggcaatttggcactctctttcacaatttttgatgcacatacccattgacccataaattctactgctctaaaatgtattccaccagacatacttgcatatatgtatgcaaagttggatgtacaaggctattcagtgcagcacggcttataataacagaagattggagacagcccgaatgtccatcaagaggggactgcttaaataaattgtaatagagtcatacaatgggaatctttatggctgttaaaaaagaatgaggcagctttctatgtatggatatgaaacaatctccaagatatattgttaagtgaaaaaaaaagcaaagtgctaaacagtgtgattagaatgctgctatttgtgagagttttttaagaatacatacacatatacatctatgcttatatatgcagagaatccctcggaaggatgacattatttgcaatatttgattctgtagaaggaaaagggttctcaaggctgagaacaaatagagagggaggcttgtttttcatcatttgccctatttactaatttggtctgtagtgaataagcacatgtcaccaattgtaattaattagtaagagttgtacttttaatcctctcttggttcctcctgcccaagaatcaaatcttggcctaacacccaaggcccttcacagtttgacttgagcctcttccccttcatttcctgacatgccacacctagcacactcccctctaagcacactgaatttctcaacttcctccaaatgcaccttgctttttcacaccgccaggacctttacacctgctgttttccatgtctgaaatgtccctccacacccccacttgcttttttttttttttttgagatggagtctcgctctgtcgcccaggcgggagtacagtggcgcgatctcggctcactgcaacctctgcctcccacgttcaagcgattcttctgcctcagcctcccgagtagctgggactataggcatgtgccaccatgcccagctaatttttgtatttttagtagagacaaggtttcaccatattggccaggctggtctcaaactcctgacctcgtgatccacctccccttggcctcctaaagtgctgggattacaggtgtgacccaccgcaccttgccccccacttgctttatacaatcttactcatccttaaagacccagaacaatcatgacccccagagtgtggccttccctgacctcaccaaagagagttaatccctctcctctgcactcccacagcaccctagacaggccttcataactggcgtggcacctggacaagaatgaacttacctctgacctatttgcaaaagagggctgctgatttggtctgtccccactgggcgccagcatctgccagcaagggtctgcacaatgtatgtatacgatgtgcccacctccccaaagaatgagaaacagagcagactctcacagcatggttcaggaaaaaaaggtcccctggacccacaagtggagacctcaatgcacatcaacttattgaaggctctgagcaactatcttagtttgagctaccataacaaagtttcatagactgggtgacttatgtacagcagaaattttttctcacaattctgcaggctggaagtcccggatcttccatggtgccagcatggttctggtgaagactcttccagggtgaagactgctgacttcttgttgtatcctcacatagtggaaagggcaaaagagctctcggaagtctcattcattcaacactaattccattcatgtaggctccacactcatgacctaatcacctcccagaggcccaacttcctaacaccattgctttgaggattaggatctccacatatgaattttggggggacataaacattctgtccataacagtagttctgcaaggaaaccaaagctgttaaatgtatttagccagcatacttctcactttctaaccaagaatttattcccttggaatgcctattaacatcccatggagctattgttctatgggcaagaaaacttttgtgaagtgttgatctatagaaatgcctacaggacttctctaattcagaacttttggccaggtgttgtggctcacgcctgtaaccccagcactttgggaggctgaggatcacctgcagtcaggagtttgagaccagcctagccaacatggcaaaaccctgtctctactaaaaatacaaaaattaaccaagcgtggtggcacacacctgtagtcccagctactcgggagggtggagcacgagaatcacttgagcccaggaggcagaggttgcagtgagccaagatcgcaccactgtactccagcctgggtgacagagcaagactctgtctccaaaaaaaaaaaaaaatcagaactttacatggacaataatgggatctggaatgttgaaactcatcttgaatgagatctccatgcagtctgctaaccagttaaactataaatcccacagttttaataaatgcaaagtgtttccagtttagtagcccagttgctcctttctaaggaattggtgacttcccaagaaatagaggttagggaatgtctccactggttcaggacttctctgactcttgtttgccattaaggatgttcgggatctggtgttgtttagtaaatatcccatcccacctcttgcatgggaatagtctctgccttgcatcagggcttttaactccattaaatccaattgcagaaaattctcagactcagctactcatcacactcactcttggcagagttttatctctgtggctccagttatatctactctcaatgtcaaaagggtcaagaacaatctcttccatcagacactgaacaggacctgcctccagtttcattcactcaaaaatggggtctctcttcttccttccttttgatctgttccaagtgtctccctgctgagtgtcatgggaagggacttggtgccccagtgttttggttggaagattcacttccaaactgaatccaacttgaagaggcttccccactaggcagagagggtgaaccttaggtgcgttgagggtatcactccctttccatgcgtcttcaacctcagcctccattcttaactattcaccctaaccacatgcactccacttctcactgcacccaagtctcctctggactcaccatcctggctatggtcttgctaagcttgttagagttaacctttggcctttcttttcagcttcctcgccaagccccctttttgataactctggggaaatgccccacttggcccagccatccaggcatacagctcctcagtgcagactctcatggcttcagagtactctgcttctagacaggaggtggaagaagaaagggtggagaaggtagattcacttcttaatctcctcagcctaaaatcagcccaaagtctttctgctcatagttcaccaatgaaaactagtcatgtgatccctatgatatgaaagggagtctgagaggtataggtcctgtctgggtagctgccagcatgaaccctattctattaaaggggaagcatgatcttttggaggtcagctagccacctcttcctcactatgtcattcctgatgttgatgatagaagtaataataaccaatgctattggcaataataataactgctcttctgcattaagcacatcctctgacacaatctttgtgctgagagttttccaggcatcatgctactcactcttccatccttcctgtgaggttagaagacttctgcttcagattctctaagaatgaggtcagatcctgttccactctgcactcagtagacatactcatgccatggtcaactctcatatctatgccgtagaggcagtcatgctacctgcccctcagaccctgagaaaggaacagaggccatcagaagggagtttctgctcatttgaattatatgtcacagaggctaagaccccaccaggttgacaagctaggcctgggttctgagtcttttgaaaattccctgttggggaagcgtatcctcagcctgcttgaactcacctactgtgtgcacccctgcaactgggctaaccatcaagagcccccccccagacaggggagatccagccagaaaagttgttaccatcttcactctctgtggcctcctcttcctatatcaggaagtcgccaaatggtgaccataaaaatacatctcccctttttctacggcttatcatcaggggaatgaatgaggacccacgtcatccaaagacctgaaggcaggtgggagtttgcctttatactcaaaagcaagagctgattccctgtgtctgcacttattgggccaatgatgcacacaaatattactgcattttacagatggagaaactaaggagtgactatgttaaagtcaagagtatgcagtagcggagctgggaaagatggctgaaaggtgggtttggctcaagataggggctctcaaagcactttgcctgagtaccttgagcttcctactcagatgtgttgagtccacaccaatacacaagtcttgggcttgaaacccttcccaggcagatcagaggaagtgggggagtggtctgcaacctagaagcagctgcacaggcagcagatggtaacggctgcctctcagatggttttttgtcacatagctttttttctttcacattatgaatttttttctgaaatcctctaaaaacattgtttttatagtaacagaggtggctgtatgtttctgagagatccagatcccacactcagtctgtcagcctgctgggatctttgcctttgtgacatatgaataaagtaagttcaagctcgctgctgcaaacagtccctggaggtgggctgcctcctcttcccagtagctagaggagccctaggattctggagaaccgagccccaagaccatcttgtcccgagtcccaaagataatgggcagtaatcccaggagagcaaggatacagagggacaaggcccctagagtgggtgggagttctgggctccaaatatgtgtgagtcttcataggaaggaaccaagagcagcataacctcaaacaagtatttaacctctctaagcctcagtttcctcatctgagcatactgatgctgtctacctcctgagattgcagggagaactgaattatgcttatgaaagggcctagcacagcacctagctcccactgttttctcaataaagactggctttgataattattttgtttgataattatttggtaattatcctaagccacaggataggaaaaataagcaataatgcaaagaccagagatgatgagagcctcaagcccagatgaaggggtcatgggtagacagactgagtcagagaggtccttgaccttacccagcaggaaggaggggctattcccaggtgagccaaggctgtgaagaaggactttggcctctaaacctcatgcccagtttggcccccacctcaattcttgttcccactgcagagaaatcttcttgcacagcctggcaggttgtaccttttaatagaggaaatactggaaacataggtgtgacatttcctatcctataaatatgccctctactcagagccagatgatactgagaaggacatccttcatgctgctacacagcatgtctgtagcctgtacagagggagtgggggtgagggggcccagtgaggcatgatagttgacctcataagcagatacttttcatggggatcaagctgtcagttttgcagggggacctgggaactctcagactgggggcattgattccaggagcctggatgcaatccactgacctacagacggaccacaggatgtgctgctccctggtgagtgggcttgagggtatgctggccccttacatgacccttgggtcaggatacgaccctcagcttgtgctggactttgaactaccaaatcctatgggtcttccagatgataaagcctcatttaaacagaatctttccaacatcccaatgattggaagatgatgattctcattttacagagatagaaaagagggagggtgaaagacggaaacattcttttttttttttttttttttttttttgagatagagtctcactttattacccaggctggagtgcaatggcatgcttaagaatcacttcagcctcaatgtcctgggttcaaatgaccctcccacctcagcctcctgagtagctaggactacaggcatgcaccaccaggtctggctaatattgtgttttttgtagagatggggtttcaccattttgcccagctggtctcgaacccctgagctaaagcaatccacccatcttggcctcccaaagtgctgggattacaggcatgcactaccatgcccggcctcattcattcctttatttatccaaccaattacttcaatattgataatctaatatattccaggtacagtgcatacactcagtacagtacactgaggcataaagaagtaaacagggtaggcaatgccctgctctcatggagcagggagataaacaattaaataatcaaataagaaatatgttattcattatttaatgtgactgtgcaaaggatatggggtaggttgaatgactggctccaattctccacccctctatgtatcaagctttttcaatataacattgcaatccctcccatccatggactttggcaaatttgggcattgttttggcccatgagatgtgagtagtcacgacataagcaagaatcttacatgagcttgtacaaggaggcttaccctcttacactttagccatagccatgagaacataccctgcctagcctgctgatcccaggagatgaacaagaagtggatgagagctgagccaccaacccatgaatgaaataaatacttactattgaatgtcactgagatgctgtgctatttttgctgttgttacacagcagtagcttaacaatgtggagcatgattagagataatgagacaggaaggtaggcaatagagaaagactgaatttagatggaggataagagatgagtcagtttcgctgaaaaagaaatattgaaacagaaatatgagtaactcatagatacacaagaatgcaaaagtggggagaagagcttcacaggcagagggaatagcatgtgcaaaggccctgaggtaagaaggagcaggatgcattccaaaaattcaaaaaaggacagggagcaaggaggccagggagcaagggagaatgtggtagcagatgatgagatcagaaaggaagttgagtaaaggaccatgcagacatatagcatgacataaagtttgcattttatctaagggcagtgggaagctaatgaagggtgttgagcataccagcacctgataaaaattccttccactgctgagtgaacaatggattaggggtaagacaagagtggggaaagggatccagggaggaggctgctgcagccaccaaagtggcaggtgttggcccaggattggcagggtactgtagagatagagaaaaggggacaaaggcagggtgtggtggctcacacctgtaatcccaacattttgggaggccaagatgggaggatttattgaggccaggatttcaagaccaacctggccaacatagcaagaccctgtctctataaaagagagagagagaaaagggaaaaaatctgaaaggtactttgaaggtaaaggtaacaggactttttccaaaaataggcctacatacacatgtcagttgacttttgaaaaacgtgccaagtcaattagatggagaaagaaggcagaaaagagagaaaaatcaatccatagtttgtaccataattaaaaattaattcaagcccaggcttggtggcccacacctgtaatcccagcactttgggaggccgaggtaggcggatcacctgaggtcaggagttcaacgccagcctgaccaatgtgatgaaatcccatctctactaaaaaaaaaaaaaaaaaaaaaaaatacaaaatttcgccaggcatgatggcacacgcctataatcccaactactggagacgctgagacacgagaatcacttgaaccctggaggtggaggttgcagtgagccaagatcacgccactgctctccagactgggtgacagagcaagattccatcccccaaatatataaataaataaataactcaaagttgagcataaagttgacttcattgatattgtttaaatttctacttcagaaaacactatcaagaaaatgagaagaattagagtgaaagcaaaaagacttctctacagaatgaaagaaaatatttgcaaatcatgcatctcataaggttctaatgtccagaatatatcaataattcttacaactcaataatagaaagacaaacaacccaatttaaaaataggcaaaagatttgaatagatattcttcaaagaagatatacaaatacccaagaagcccatgaaagcatgctcaacatcattagtcattagggaaatgtaaatcaaaaccacaacaagataccatttcacactcatcaggatagctatcatcgaaaagatgaacaataacaagtgttggtcaggatgtgcagaaattgggaccctcatacattactggtgaagctgctttggaaagcagtttggcagttcctcaaaaagttaaacattgagttaccatgtgacccagcaattctattccttggtatatacacaaaaggaaaaaaaaaagttctcacaaaacttatatgcaaatgtctgtagcagcaattattcctaatagccaaaaaaaattgaaacaaccaaaatgccaaccaattgatgaatggataaacaaaatgtgatttatccatacaatattcctgaatttaatattcagcagtaaaaaataatgaagtattgacacatgctaccacgtgggtgaaactttaaaacatcatgctaagtgaaagaagccagtcacaaaggatgacatgttgtatgactccatttctatgaaatatcaagaatggttaaatctatagagatacaaagtagattaatgtcttccaggggttggaagaagaggggaatgggaagtgcttgctaatgggaagggagtttctttgtattttttattatctcatagtaaagctttaataaacatcagtttccatcctcccagttctagccaaattactttaataaaatatatctgtatatacagttttttcagcttttattttggattcaaatttggtacatgttcaggtttgttacatgggtatattgcatgatgctgaggtttgggatatggatgatcccatcacccagaaagtgagaggtagagaaccaataggtagtttttcaggccacatctcctctctactcgagtggtccccagtgtctattgcttgtgatggcatttcatcgggggcgatgagaatgttctggaattagagagtgatgattgtacaactgcatgaatataccaaaaaccactaaatggtatgctttaaatgggtgaactgtatggtacataaatgtatggtacataaattttatctcaatgaagctgttaaccaaaaataaaagagcatagacctaatgtaaagcctaaaactataactcttcagaagaaatataggagaaaatccttgtaagtttgagtgaggcaaagatttcttgtatatgacatcgaataagaaaaacaagtgataagttggacctcattaaaattaagaactattattctttcaaagaagacactgttaagagaatgaaaaggaaagccataggatgggaaaaagtgtttgtaaatgacatatatgataaagaatttatattccaaatatacaaaactatcaaaactcaataataagcaaaacagcccaatattttttaaaataggcaaaaattgtgaatagacacttccccaaagaagatattgggatggcaaataaccacatgaaaacaaggttcgacatcatcactccttagggaaatgcaaattaaaatcacaatgagataaaatgaagtattctgtcccccacaaagacttgtacacatatttccacagcaacattggttgtaatagccaaaagctggaaaaaatacaaatgccatcaacaggtgaaagaatcaacaagaagcggtatacccatacagtgggatactacccagcaattaaaaggaatgaactactgacacatgtaacaatatagatgagtctcaaagtaattataatgagtttaaaagtcaggccaaaaatgcatactgtataatttcatttatataaaattctagaaaaagcaaactaatctgtagtgacagaaagcagagtggtggttcactaaggatgaaatacacgggagaggtgggaggggcaggagggagaatatcaaaggatcataaggaaacattgggaagggatggatatgtttatttattatcttctgtgtggtgatgctctcccaggggcataggcatgtgaaaacttttccagttgtgcatttcaaatacgtgtattttattgtatgtcaattgtacctccataatgctataaaaaaattaataggacttgttgatgaactggatatggaggtgagagggggagaaatgtcagggataacctccaggcttctggcttgagtcaactgttggatggaggggcagtttcctgacgggaatgttcaaaagaggacacggttagggtgccttagcacatggcagagaggtcaagaacagagtttttgagatgtgaaatttgatgtcccattgaaaatgtacagaatgtggttgtgaatctgagcctgtggctgaaaagagagatcatggttcaagaaaaggaagaaggggccaggcacagtggctcacatctgtaatcccaacactttgggaagccgaggcggtcagattgattgaggtcaggagtttgagaccagcctggccaacatggtaaaactctgtctctactaaaaaatacaaaaaataaaaattagccgggtgtggtggcgcttgcctgtagtgccagctactcgggaggctgaggcgggagaattacttgaacctgggaggcggagtttgcagtgagccaagacagcaccactacactccagcctgggcaacagaacaaaacttcatctcaaaaataaagggggcgaggcggggagagggaactcatgcagggaaaaccgtgagccaagacatggaggatgggaacaagggggaggaacagaaagggagtccttcactggggtggggttagggcaagaagcagtgagcagagagggagcccccaggtggctgtgttgggacctgctggattcacagggcagggaggatgacaagctctgggagtcctagaaagggatttgatttgaggtgttgggacaggagaaatgaagccatcagctttagagctgccacatcccgttgggacattccacagggagctggatcctgggatctggatgaccaaggagagatgtggtgcagagagggatctagggcttccctggcaagagtatgttggcccaggaggagtgggggtggtggaagagaaagatagagatgcaggagctctcagagaagccccaggagagtacgtgagaatggagacggcatcaggctaggggcaaagtagggtgacagccagacccacgaagtccccagaggtcttacaggaacatctcagggcaaggacccagagcagtgtgtgccaagggctggtcaccagagctgaaaagggagatagccttggaaggagggagatgtgctggtccctacaaggctctggcatatacatctcctcactgagtgctcacaactcctttatgagatcaccgtaatcatctgcattgcacagacaagaaaactgagaatcagagaggttaggagacttctcccaaggccacgaaccttgtatctcatccacatctgggggctcacacgctctttttaggcactagggtgcccagaaaaaggttcacaggggccaccaagcaccaactaatgacccccagggtggctgtgcacaagcatgtctgaggcagttagatgaaggagggagcgcagctaattgcccgtacaaattaactctaatgtggtcggcatcgacatacttatctttctttaattacattaatcaattaatgaagaagatggcttcctcttattatgatttccaaggcccatatgttctcgggagtccagctggagttgggcttcttctctgtccctggcttgaatggagaactgagtgacatcaataagagaaattgtcccccaggccttctccaccctgaagctgatcttcaagatgggagaggtaagaaaacagaagcaatgatccccggaaatggtaaccaatgggagaggcctaaactccttgactcagcattcaaggcccttctccaacattgttcatggttcctttgacccaggtttatcagcctgggcagactgattttctctgagctgcccttgcatcctccagcgtccaatgcattcatgccatttcctctaccaggaaggccagctcccatcagtcagggtccaggtcagtccagtgggtttgtcacctcctcatgagaaccctatagaaggcctaccctgcagtaatctccttcacttgttaatttttttcagctttatttaggtataattgacaaattaaaattgcatacttttaagatatataactggatgtttgatatacatacacattatgaaatgattaccacaatcaagctaagtaccatacccatcacctcacttggttaccattttcttttcttttttttcctctgtgtatgtgtgtgtggtgagaacacttaacatctaccctcccagcaagtttcaaatatgcaatatagcattggtcactatagtcgcccggctctacattaactctccagaacttgttcatctggcataactgagacttggtaccccttaaccaacatctacccccagccccgggcagccaccattctactccctccttctatgtgttcggctgttttagattccacatgttagcgaaatcttacagtgtttgtctttctgtgtctgacatttcacttagcataatgccttccaggttcattcatgttgttgggaatgacaagattttcttcttttataagtttgaataataattcacatttattattcacattttctttatccatttatctattgacagacatttaggttgttttcatatcttaactactgtgaatattggtacagccataatggaagacagtatggagggtcctcaaaacattaaaaatagagctaccatatgatccagcaatcccacttatgggtgtataaggaaataaaatcagtattgcaaagaaatatcctcactcccatgcattcatttttcattcaacaaatatttacagtccctccccttgtgtaacttctaaaccttcgggacagacagacactaaacagacaaataattacatagactggtggttctcgtccactagaatcatcaggggagcttttaaaaatatgctgctcacgtgggcccagtggctcacacctgtcatcccagcactttgggaggccaaggcaggtggatcacttgaggccaggagttcaaaaccagcctggccaacgtggcaaaatcccatctctactaaaaatacaaaaattagccaggcgtggtggtgcaagcctgtagtcccagctactcggaggcttgaacccaggaggcagaggttgcagtgagccgagatcacaccactgcactccagcctgggtggcagagcgaggctctttctcaaaacacacacacacacacacacacacacacacagagacacacagacacacacacacacaaagtgtgatgcttaagcttcatcccagaaaaactaaagctgaatctctgagggcacaagctgggcatcaattatttttttaattgcctaggtaatgctagtgtgcagtcaggctgacatgctggcatgggggataaaggagggtaattgtaaggagggtaatctgcaatgctgccacccgggcttgctttccctagaggttttgaaagtatgatcagtcaattgtgttttttgtaattatttatttaaataagataaacttatattagccaccccgtcttccatgtataaagaagtcacaaattacttagatcagtgcttctcaaactgtagcaaacatcggaatcacctggagggcttgttgaaccagatcactgggcaccacttcgagcccaagaatttgcatctctcacaagttcccaggtgacactgatgctgctggtctggaaactccactttgagaaacactgaattggagcaaggtttaaagaaattcaagtggttgagcaccttccttcctcactaaacatctgctgttcacagactctgtttaaccaaactctgctgctttctcgcaagctgatgtagaaagccttcagatctcctttgttaggagaagaagctgtgaaaaatcatacctctccatcatacatgtgcctgttttcactgcaggatgtttcacaaccacattgcttcagagcaggcaacttctcttctttaactgccaatttctcatcacagcagtggctgtcagcatcagcatcactggacacctgttagacatgcaaattcctggcctactccaggcccacttaatcagaaactctgggagtgaagcccagcagtctgtgaactaggaaatcacacaggtgattctgatgtactctcaactatgagaaccactggcctagaaaaaaacgtgttaattgccccttcgaattcttcaggatcctattcactctgattatttgtatcatttctttcataaaaataataataatttgcttccatttgtcaagtcttcctatgtgccagggactgtgctaagtactttacattaaagatcttatttaaaccttggaacaacccaatattcattatactattttatagataaggaaactaaagcttggagaggttgagagttcggcccacctgttaagtggcaaacccaggaaaacactgctctctgccccaccccggttcatcttttccaaacattaggcattgtattaagtgtgttctcacactgctataaagaactacttgagacggggtaatttatgaagaaaagacgtttaattgacccagttctgtaggctgtacaagaagcatggctgagagacctcaggaaacacaatcaaggctgaaggtaaaagggaacaaacatgtcttaccatggcgagcaagagaaagagagtgaaaggggaagtgctacacactcttaaacaaccagatcttatgagaactcactatcacaagaacagcaagggggaaatctgcccccatgatccaatcacctcccaccaggtacctcccccaactttgggaattacaattcgacatgagagttgggtggggacacagagccaaaccatatcaggcacttatcacacccatatggctgtggtttatacctccattgtagtgctttcccccagtcataagatttgtttaatatctcactacttttttctacccaaatacctgctttttaaagctagtgttcattttcttaaaaaaaactaattgttgaaatgttttaaaatcatctgtttgctgccctaactgatatcatgcatttttcttttatgaaaattgtaaagctcagttaaatgtttaaaatgcaaagagcagacacccaagtttccttactggaatgaaatgtaaatggaaagtggcactccacaggtacaactaccttaaggtccatattgcttaaaagagtggaactcaagagccaggagccatgacttgcaccagtagtcccagctacttgggaggctgaggtgggaggattgcttgagaccagctcaaagcctcagtgaaccatgatcatactactgcaccccagcctgggtgacaaaaaaaagaatggaactcaacgtgaaaagtatgtgacctcaagtccaaacagtcattctccaatacattggaagcctattactcacatccgaaggtgttttaatcagccagtcaacccgttatctaccatgtggatgaagtggtcaacgtgactcacctggaaatgtgctacgggatagagattattccaaaacatggcaataactacctggtgtcttcagcaggagtaatgtgcaactactctgtgttacaatcacagacagcctacggtgaccaacaggccccagtttgcccaggactgtcccagttttgacactgaaagttctgagtcccagaaaacagttggccaccctaacagcaccatgcttgactcacatcaaggtgcatgagaaggagtttctgtttccctttggccagccaggggcctgggtctagggctcccatggggcaggacactctggccaggatcagtgtcaaagaactgcctagcagaaggaatatgtcttagttccagctgctctagcaaaatactgtaatctgggtgggtttaaacaagtatttatttctcacattgctggaggctggaaatccgatatctctcttataccctcaaagagagagctctggtgtcttcatcccttcataaggggcaatgaatcccatcaggatatttttctcatgtcctaactactgccctaaagccctgcctcttaataccatcatattgaagatttagtcttcaacatataaatttgaggggacccattcagtccatagcagggtacttggggacagaagggaaactagtctgagcagtgaccacatttcctcctaactgccctcccctcccccaggtaaactccagatgattctggggcaggagctccacccccacgtatcaacctcttcctccaatagaaacaaagcccaggccagtcctctgggatgggagggaggggacatcaacagaggacagagacagctgaagactccattcctggcttcctctcggctctcctgtgccacagaaggcagagaaggtgggagaaaatgtccatccagccctaaaaccctgggcctcctgagctggctgggccaccctgctgcccacagtgggtccacaaaagcaggggcttggcagctgagacggtgagctgatgaggccacccatgataggtgggtgcttagtgcacacctagacaatgtgtaagtgctcagtgaatctgagctgtttttaagcagctatcgcccactgggacccaggacgtgcagaatgggctcatcctccctccctccgcctctcctgttcccattgcagccccacctcttccattgctgtgtggctgagagttaccctgagtgtcagttttctcatctacaaaatagaaagagtaatagtcccaacctcacagagtctccctggggagtaaatgaaacagggtgtgtagtagcctactttggacgtagtaaaggctcagtgagatcatcattgtcattcctcttatcaccaagggcacccaggggttggggaggcactgaggcaggaagaggaggggagggtcccacatccttcctcagcctcgaagcaggaggcctgagctccatatcctatttgttctttccacaacaccagtgccgacttctccattaggcattgtagcaattcagtgtccacaacattttagagacccacagaatgttctcatttccttcaaaatcaagtaaaatataaacttttaggttagacagacatgtttcattttcttctttcatcagaaacaaatagaatttttaggacccatgaaaatctattcttgtgggaggggcccatgaaggcagaagcgtctagggcccacaaaagtcacaatgcagccctgctcaaaagacaaaaacaaaaaactgtgcctgggccggccgcggtggctcatgcctgtaatcccagcactttgggaggccgaggcaggcggatcacttgaggtcaggagttcgagaacagcctgggcaatatggtgaaaccccgtctctactaaaaatacaaaaattagccgggcatggtggtgggcacctgtcccagctactcgggaggttgaggcacgagaatcgcttgaacccaggaggcggaggttgcagtgagccgagatcatgtcactgcattccaacctgggcaatagggcaagactcagtctcaaaaaaaataaaaaataaaaataaaaaaatcctgtacctgcctttttttcatccccactgctgcacccgtcctaactcaacccatgtccacctctcacctagacaatgaccagagcctcccagcaagtctcccagcctgtctctgaaatccttgtatctgtcctccacagagcagccagcatgatctgtcgaaatcacaaatctgaccttgcctcctccctcctgaaaacctgctgtgcctctggattgccctcaagacaaaagtccaaactcccctgcaaggcacacaagtccccagggggcactcagctgcactctcctgcacgcgcccagccttcctgctttcacacctccacacctttgcacttacagtgccctctacccagaacaccctttcccccgcaaactcctaaccatccttcaaagcccagctcctctcagagaaattccactcatttgtcatattgtgattttgagtgaatatcacctcgaggtcaaggactatgttttcttccttttcatccccccaaccacctccccagtgcctagcttacagcgactgtctggcagtgtttattgttcccctgaggtcatggtcagcatcggggtgctcctctaacccactgctccctgccccggcaccgctgcagtcctgtgatttccaaatgccaagggaagttctgtggtcctattcatcttttccttgtctggcaggctgggagtgcagcccctctggggcgcacagacagcagagtagccctgaatgggtcaacctttcaccaacaacacccacctcaaataaaagccatcagcttgccaggattggagaggaagcttcaagtccccaagaaaaacccaagggccatgttcagagacttggccagaactgagccctgttcagcctttgtctgtgtgtgacagtgtgcctctctgtgcctcagtttctccatctcataacagtgaattggtctaaagcctcgaaagaaagggttcttccaactccggctgcacagcctcttccagggcctcccatcagcccagacccagttaccaacgcagagggaagagtgccacctactgactcccagcctccctccaagacactgagccaccaaaggagtcagcggaatgtgcaaagctcaaagtgagcagttgtctgcattctccctttgcagagccgcagcaacctcccctttcatggggccaaggggcacccctccagcctggacagagagctttagctgcactgctcacccctgttgtcctctgctccaagccctggaaagccaggcgcctccacgccatcctgcatctgtgccaggcccaacagcacggtagcccccggctgccagcccccctcacactgggccggcggctagaggtggagaacaatgatccctattgtgactaaatttccccctgaagatctcattcaagatgttagagtgagcgatcataaaaggaattaatagttgattcgctgtataatttcctagttcaatatactttagtgcagcaactaaatgaggcgtcccggccgttcagtggggccagatagcgactttatcactgggatctcaggctgaggaataaaagcaattcttctgaagtaattgcgtctaattaaaagaaacatttaaaaagtgtaaccaaaaggaattcatttcaaatggaaaattaatgctgaaaaatagccctgagctctcttgtcgcagctaatagccaggcagccgcagaataattaaactgttttgaaatgtcgataccatcctcatcgggagaagatgggcacggctgagcacatcccgggcatcagcaaagaggatggcttccaaagacatggccagcagttggacttgaggtcagccacaggcttccaggtggggtgaggcccaagtcaccacagacaaggcaggaaaaggtttgtaatacggtatttaatgaaggaaaccccacttcctggatatctgagcaccccactgactcttcagaacaaccctgcaagtcaagtatcattagtagtattatcatcatcatcatcattgccatcatcagttcaaaaaggagactccttgtgactagctaccttgtctaaaatcacagccaatatgtattaacagcaatcaggatttgaactcaggtctgcctggctctgaagtccacatcaattccactacactggatgttaggattcagcatcaggaaaaaggctgtgtgttttctaacactgtcattctcagttctgcctgcattagactcacctgacacccccctgaggagctttaaaaaacagtcccaagccaggcgcggcggctcacgcctgtaatcccaacactttgggaggccaaggcgagcagatcacaaggtcaagagatcgagtccatcctggccaacatggtgaaatcccgtctctactaaaaatacaaaaattagtgggtgtggtggcacatgcctgtaatcccagctacccgggaggctgaggcaggagaattgcttgaacccaggaggtggaggttgcagtgagccttgatcacaccactgtactccatccagcctggtgacagagcaagactctgtcaaaaaaaaaaaaaaaaaaaaccagtcccagactctgccctcaaagactctgcctttattgatctgggaacagcatggggatgagcatttttttttcgagatagggtctcgctctgttgcccaggctgaagtgcagtggtatgatcacagctctctgtagccttgacctcctgggctcaagcgatcctcccacctcagcctcccaagtagcttggactacagacacacaccaccatgcctggataatttttttctttttaaagatggtgtctcaccatgctgcccagtctgtggacatcagttttttgtttttttttttttatgtttcccaggtgacttaactgtgcagctcgggtctagaaccattagtctaaatcccagtcatcaggcacccttcaccccatgaacattccctgaaattttcctgctcacttcccccggggagttttgcctcgtgaaaaatcgaagggtgaacacttcccttacaagtttgcagccaggttgaaatgaactaaaagagactaattgagaaccagcacttagtacatgctaaataaatgttagttttgaaatggggggcagcaagaagtaagaacccaagatgaaatcgtcctaaaggagtcctgaagcagaccccaagggaaggttcttggaccttgagcaagaaagaatttgaggcaagtccatagggtaaatttaaagcaagtttattaggaaagtaaagaaataaagaatggttactccataggcagagcagtggaatggaatgcttgactaagtatacttatagtaactttttggctatatgtttaacaaggggtggattattcatgagttttccgggaaaggagcaggcaattcctggaactgaaggttcctcccctttttagaccatatagggtaactttctgaggtcccatggcatttgtaaactgtcatggtgctggggaggcatgtcttttagcatgctaatgcattataattaccgtataaggagaagtaaggacgacccgaggtcactttcatgaccatcttgatttgggtgagttttggcctgcttctttaccacaaactgttttatcttcaaggtctttatgacctatatcttgtgccaatcttctatctcatcctgtgactaagaatgtctaacctcctgggaatgcagcctggtaaggtctcagccttattttactcagccgctattcaagatggagttgctctggttcaaatgcctccgagaaaatgtctaccaagcattaactatagcttctaactccgttaaaacctggggccaggtgtggaaaactaaatctgaaaagtttaacagtgaagatgatctggccagaaggtttatataccaaagtgaattcagaatgggggaagatcacactagctttagcaccaaatcttacagttttgtttacagttacttgaactaggctaggagttgccttcaatcagtgattatggagcatgctttaatgaactagaagaacaattcgtaatccatgagttgtttattatgctgaaagacactcctaaagaccttgagaatgttccctaaaagtttgtcccccaagtagatttaaacatgcacctaaaccttatttacacccttatgattttcagaaaacaccttctttacacatatgcaaagatcccagtgccccttttctgaattgcaaatacaacccaatttccaaagatcatcagcaagcaccatctgcttcattatggctaaaccccttaaaagggaacccggggtctctaagggtgatggaggacttgggatgaaccactcataagaaaagcatcatcttaccttctgatgaaatggtgcttatagtgaccacaggggattggccaaggctgagggattttcccaacattctgaggttttttttgttatttctttgcctgaggactttctctgtccacaaaagccactttgtccacctctgtggcatgccagaagtgccacacacacacccaaagcagctctcaaccaatgcatggtgaaagtcggtggacaaatgccccagctccctcacctcatgggtggaataactctatggtgtagtccatacagactgccacagttccccagcacgattaagcctcaaccaccccgggagcgctaacaggatgatggcctctttattgtctgccttctcctccctgtctcacttcctcactctcttagctgtattgccttttatctccaagataaactgcttgcatttgagtcaatatctgctaggacaggggtaagaacaatacctttgggaccattgggttagcagttgtggtggagatccactccagtatggcccctgtgcctgctgcatgaaaagaggatgggcttttggagcagagatgcctaagctccaaatctggtccagctatttaccagctgtgtgacttagggaaagtcagagagcctcgctgagcctctctgtcctctagtaagatatgggaatagtaatgggagccactgcaatcagttgttgaaaagatgcattgaaattctgcagactaagcccatggcacaagcaggtgtttattcaaaaagtattagtagatttattccataatgggctctgagtgtggcacagtgaggtgtgcaaaggatgaggccagatcccccttcctggagctcccagggagatcagatgtaaggagattagtcatgatgttgccatttatgctgggaaactcacgggctgggggcagctggggagctgcaccaaggtctccaagagtctagctgtgtggtccaataggaagccaccaaccacatgtggctatttaaatttacattaattaaaattaaatacaatgtaaaattcagttcctcagtctcactagccacatttcaagttctcagtagccacatgtggctcgtggctaccatgttgggcagtgcggatctagaacatttccaccatcgtagaaagttctgcactggcctagtattgacccggaattcagatctagcactgtccttgctggctgtcagatttgggcataggtcctttcctccttgagcctcagtttcttctcctgtgaaatgggctgtactaatcatgtcactctaagcagcgcggttattgcaagcaccaaattaaaagttttcgtgaaaccactagacaagcaccttgtctggaagactctagaagcataaataacgttgaccaaatctacttcagcatttggtcttgcctttcttcatcttagatcccggggtcccgaacctccctgtttttctacctgggccctcaccacactccacttccatccccactccccaatccatcctctgtgatcactgtccctctcatctccaactctgcccacgccttcaggcaatcagcacatagactaagtccttactggggtctgcacagacagaaccaaaggcttggacacatgaagagtggagatcagggaaaaggctttcctgggctctaagagatgagcttggaaaagggatgtccctaaaggcatgttactaagtggaagaagccaatctgaaatgggtacacactgtatggttccaactatgtaacattctggaaaagacaaaactatggagacaaaacaataaaaagaccagaggttgccagagagggatgaataacagagcatggaagatttttagggcagtgaaactattgcatatggtactataatggtgatacaagtcatcagacatttgtcaaaacccatagaatagccaacaccaagagtgaaccctcgtgtaaactatgggccctgggtgatactgatgtgtcaaggtaggttcgctgattgtgacaaatgtcccactcccagcaggatgttgatcgtgagggagcttctgggtaagggtgggggtaggggaatgtgggaactctgtactttccacttaattttgctatggacctgaaaatgctctaaaagaataaagtcttctttaaaaaaaaagatggaactgactttcagtaccttggtccagtgaagatgccaacagcagtaaccagttagaggatggacgagccatcatttggggggcaagtgaaaaagacacattccaaggctcaataaaaaatacatttttttaagaatgcaaaagaaaagatcctgccagagtggaagggagcagcacttagcttagatctgtggcacccaggatgccctgggaccctcctgttcttagccacaccccagcctgaccctacaaagtcaagccttgcagggtagaaccttcataatcttccagccatcatagcccctgtgcctgacactttcatttctctttatttgctcattctcttccttccaccacaccatgctcaaatcatccaaaactttccctttatcactgagcctccctaattaagctaacattattagaaggttgggaaaaaaagaaaaagaaaaccctcccaaattctctttgcgtttcagtagctctttaatatgcgaggcaacgagagatgagctgctcctaattgccagtccctggagtagccagtcagaaaatgaattgatgcgttttttccttatgaacaatgcatgtagcacaaattgcagtggccgtcaccagagatttaattacaaaatatcattactttcacacatcatttcagatttggcctgatcaaatcaaagttagggcgagagggagagaaaactgcactcttagcagggacattcattcaggggtggctgcaacgcgggtgggaattggcattgtcgaaacttcctcggggccattgcaggggaagcagctgccagagatgtctatgcaaagggacgtttctgggattcagggtttcagcagagtggaggctgtgggcctgcaggaggggccccagggcgtgaggagcatccctcaaggaagaaatcaggctgcagagagtcttaggaccctgcaattcaaaggagctacagaaagtcccttcatcagtggctcatgtctccagttcattcattccacaaatatttgttgagcacctagtgtgtgccagatgctgcgccagaccctggggaggcaaaattgtcagcaaacaaacgtggtctctgccttcagcaggttcacactctggttgggaaaacagatttgaatcgaataatcacagcatagtgagagacaagaggggtagtggagcccagactctctggaatttgaattcctgctccatccatccatcagcttacactctgaaaatggaaaaaatataaataacacgaatccctgttccatcctttaacagctgtgtgaccttggcttggtcactcagcctcttggtgcctcagcttcctcatctgtgacatggggaaaataatagactgggtgcagtggttcacatgtaattctagcactttgggaggctgaggcaggaggattgcttgaggccaggagtttgagaccagcctaagcaatgtagcaagactctgtctctacaaaaaaatttaaaaattagctgggtgtggtaatgtgtgcttgtaatcccagctactcgggaggctgaggcgggaagatcacttgagcccaggagttcaagactgcagtgagcagtgatggtgccactgcactccagcctgggtgacagagcaagaccctgtctctaaaaataataataataatagtacttgcctcaaaaatgtattgaagattagatgacttaatatttataatacacttggagtagtgcttggtatatggtaagctccatgtaagtgtttgttaaatgaatacaaacttaaaactgcaactgtaaaaagcaaagtatgtcatattctgagagtctataataaaaggattcaacctagccagggaaatcaggaagggcttgagctgaaatgcaaaggagggggtacattaattaagggaaacactaaagtagagtagtcttagcagagaaaccagcacatgcaaaagctctgtggcaggaggaagcattttaaggacaaggcactggaaaaaaaggccaatgtggctggaacgtggtgcaagctaaggatgaggaagttggtagggctagtccatatagggccttgtaggccatagtcaagagtttggactataaaaattactcgtgagctttagaatcttctctcagctagctttagttgagatagatttattgcaaaggtggcccaaattttttccttccctgtacccacatcccttccaatgagactttacagctcctcccatcaagaggtgaagtctattttcccatcccttgaatctgggctggcctggtgacttgctttgcctgatagaatgtgctggaaatgacaccgtgccagttccgagcgtgggcctcgagcagctgggcatgattctgctgcttttcctggaaccctgctcagtcaccattagcacaagtttggcctagcctgctggagggtgagagaccacgcagagcataaatgagtcatcccagtcaaggctgtgctagatcagccaaaaatcagtaacacatgagggatccccagctgagagttagtaaaactgttcagccaagcccagcaatgatcagcagaaccacccagctgacccacagaattatgagttacatacacagccattgtttttaaccacaaagttttagaatggtttgttacacagcagtagctaactgatacacacattgaggggtcaggagcatggtaagaaatgaggggggtggggacaaagaaaggaagaagaattaggaggaggaggagaaggagggagaaagagactatagcaaggtgtaatgctgacacatccaagatgtgcacagagctctgggagcacctaggaggaagaacttagttctgcagggaagaacgaagagccacagtcaggagaggctttccagacgacaaaaaatgagcacatgtctgtccagggaggacaggcgagagaagaaagaacatgggcaaaggcatggagtcatgaaaagagaggaggcttggtcaagagcagggaaaatggttggggcagccatgggccctgggcacgtgagcatcagccttctataggccatgctaggggcagagctaaaggtgtagcaccagctaaggagcacccagctaggaggaggctggaaggacctgatatgaacacttgctgtggttgcagaagatggggtgagggatttggacagagagttccaggatagatacaaccacagcaaggggggaccaggaagcagggatcctcaagacccacatagctcttggaagtggtgtaggtcacaagggcatctaggaccccacaagccaagatcatttcacgactgtgtggccttaggcaggtctgtcctctctgagcctggcctctcggaggttctaccgaggaactcataaatgaaggctgggaaggcactttgtaaaccaaaccgtgaagcccatgcaattggatggggtggagttactcgcattcctcattcggtgtatttcctccggttttatccaaaaacggaagttttcccagaaaaccatgcatcagtcagaatcccaaaggaaacaggtagtaattgaggagggtttaattttttttttaagtgagcaaaacaccaggatggtgccacactccatgaacagcaacagtggggaacccttaccacaccaaggcctgcagggacaaggaggagagcagttagtgggggctagggagagaaggggctgccaacagcagctgcagcttcagccaccaacctggtggggagggagctggagaaataaatgtcccaaacctcactgtcctcccaccctccagtctccggctagaacctcccattggttgaacccattccagaagttggaagcttgtaatacactcataagtcagaccccagggccagagcagggggaggaggtgggcagaggacctgggtgagcacagaaagacatcagcactacctccatagagggtgtgtgggaggagaagaaaataggctctttaagacctagcaagacataggccagggacaggattcagcgtctccagaagaccacctctgtgtccaggcccttctccaggctgtctccatttcagtggttctcacattggagtctggggaccctggaggcccctggaaccctttcagggggtccacaaggtcaaaactgttttcataataatgctaagatattatttgccttttgactctcattcttccatggatatatggaggagttttccagaggctacttgatatagccacaattacctgaaaagactattaaaatccttccttctttttctaactgcatattggaatgagaccggattttcttcatacccttgaaccaaaacaacttatcagaacttatcagattgaatgcaaaagtaaatatgaggccaggtgtggtggctcttgccagtaatcccagcacttcgggaggccgagcgcggcagattgcgtgagttcaggagttggagatcggcctgggcaacgtggtgaaaccccatctctactaaaaatacaaaaaaaatagccaggcttggtggtgcatgcctgtagtcccagctacttgggaggctgaggcatgagaatcacttgaacccaggaggcagaggttgcagtgagccaagatcaagccactgcactccagcctgggcaacagagtgacactgtctcaaaaaaaaaaaaaaaaaaaaaaagtagatatgagactctaaagatttgcaaaaaatagagtacaatgacactcttctcacattcttcttactttagaaaatagttatttttcaataaaaatgttatttatgttgatatgtattgggcttatgattgtttaagtcagtaagtaaattttttttaatttctaatataataaatattgatagagctcacatagagaaaaagttcatggtggggggggtctttgacaatttttaggcacataatagggtcctgaaaccaagaagtttgacaccacaatgctcagaaaaactctctaaggaagttcctggtgtcacgctcttgttcgggaagaggaagctgaggccaagagaggggatgacagctagccggggttacacagctggttggtggctcagctgggattcaaatctgggctgtctggcaccaaagcacgctcacactctccccattgcccctgcggcaagaagccacaggagcagtggatggtggaacagcacctggcttctgccacctcttctaagaagggaacttgacagggattgattgatctcaatgatcagctacaaatggtctctacacgtggccatgttaatcagctcctaccagccaggatctgaccagtttgaaaggtttatagcaacaatgtggtgctgatttatttctccttaataaaaaagtgatcaagtgaaacctgcatctatcattctatttatcactcgggatgatttattgactaattacacttgcagtggccgctggctctaagtatggacgatggggggaggtggggtcagtccggccatcagtgctgccctggacacgtctgccgccttccgttccagccttgccattcacatgtaggcaagaacatgctctcgaatatggatgttcagactctgaaggaagcgggagagaagggagaaaggggtaggtgagaaatggagagattgtctggtcccagccatttgccccttcctgcccctttatccatggagaagacacggtgcagagagcagcaggcagggtcgccaggtaaacacggttgctcagttactttcaaatctcagataaacaatgaacaattttttagggtaagaatgtcccaaatattgcatagatgtcatgtaaaacctggcaaccctggccccagggccatgagggacctggtagagtattgagctgatgtcactatgagaagttccagtgtccataaccatagcccagtctcactctgcacgctgctctccccctgctcaacccatgggcgtcccactaggggctctgggaagatgtgacttctcggagctggtgggcaaatcacacagccttgctgagccttatctgcaaaacagaggctcccagcctgtcccagttcttccccttcatgctgcacagggctgatggggatggacaagtctgtcccttgccagctacatggtggagggcctatggcaagggctgccattggggctggcaagactgggcccccatccaccctaggaaggttgagtttcctttagtcctcttgaagacatagtaactataactcaaaacttttgtttgtatcattttccttgaaaccttggctttgagctaggaaaggacagagggtcagctggcacagcctttgtggaaaagcgcagtgtatctatcaaagttaaaaataagtggatgttgtggcctgtaatcccagcactttgggaggctgaggcgggcggaccacctgaggtcaggagtttgagaccagcctgaccaacatggcgaaaacccgtctctaccaaaaatacaaaaaaattagccaggcgtcttggcgcgcgcctataatcccagctactcgggaggctgaggcaggataatcgcttgaacctgggaggcagaggttacagtgagccaagattgtgccactgcgctccagcctgggcaacagaacaggactccatctcaaaataataacaataataaataagtgcctgttgtatttaaaatagaagcactatatgaggacttagtaaatcaatcaaccaataactacccctttgacatagcaatcccactcccaagcatccaaaccagggaataacaaggatgtttctattaataccgccaagtcacaaacaacctgaaatcaatctaaaggggatgagatggatggactgtgatgtagtcaaaagaagacacagaagtcatcagaatgagagaaagatattgcctaacctgcaaagatttccaagatatattattattattaatcattattattattagaaaaaagcaagttgagaacgttccagaccaggattcctcaaccttggcactactgacattttgggccggatcattcttcgtgttgggggctgtccggggcaaggcaggctgtttagcaacactcctttagcactctacacaccagatgccaggagcacctccctccccagccatgatgatcaaaaatgtcttcagatggtgtcaaatgtctcctggggagtaaaattccctccccatcccgctttcccaccccccacagtgagaactggtctagacagcattgtcaggaatgtttacatgaaccaaagtaaacacctaactagaacttctataggaacttaggtaaatgtatgaatgcatagcagaaagtctgaagggagtctccaaactgggagctggggttgtctctgaggagggaattgggaatttgggtgggggggaagagagggatctggggagacctttgcttttgttgtatgatctgcatgtttgaccatgagaatgcatgcatctgttcagtacttttttgttctttgtttgttttctttgagaaggagtctcactctgtcgctcaggctggagtgcagtggcgccatctcggttcactacaacctccacctcccgggttcaaggaattctcctgcctcagcctcccaagtagctgagactacaggtgcccaccaccacgcccagctaatttttgtatttctagtagagatgaggtttcgccatgttggccaggctggtctcaaactcccgatctcaggtgacccaccagcctcagcctcccaaagtgctgggattacaggcctgtgccactgcacccagccatctgttcagtactttcattataagagagaaaggaggagagggaagggaaagggagggaaggggaggggaagggaatcaatgggaaaggagggtcaagaaggagaaggagagaaggaaggaagggagggaggaagagaggaaggaaggaaggaaagaaggagggaaggaaggaaggaaagaaggagggaaggaaggaaggaggagggaaggaaggaaggaaggaaagaaggaaggaaggaaggaaagagggaagaaaggaaggaaggaaagaaagaagggaggaagggagggagggagggagggaatgagtggcagaagccaagtctgcagttgggaaatcatgggacgtgctggcttttcctctctgatcctcagtgtcctcaaagagaaaggcacagcataaacaggtctctaaagacccctcctgccccgtccactgttgaagagagccccaaggtgacctggccccctccctcccggctgtccctcccacacaacccagttgttgcacaaagaaaagaagtgcttggggcttctcctccctctcagcatctctgattatgcctccctgcaggaggaggggaggttggggcctggtcagcagcccagctccacaccgaggacttgaggactcgctggagcttgattaaataattacacagaatctactgagtaatcatgcccgtctcaagaagcaaggagcaccttcagagggaggtcccattagtgatttgggggcgtgtgagtgtatttgtctactgcctatgataaaattatcatcagaaggcctcatttacaaaatgcatccctttcccccatctccttccatcacctcccaaacccagagatgtgtataatgtaatccccattccacggcagaggacagggactcacgagctttggggctggctcaaggtcccagcagcaggggctggtggcaaaggtggtcaaataccagaaagtgcacacagagtggggacaaggctcaggactgaaacattttagaagaggttttgtttgttttttattgttttgttttgttttctcgctaggattatttctctcctttcagtttttgaaaacaaatctaaaatcagccatgggagcctccctaggtcttgctgccaagaaaacagccgagcatggagggtgagggctgggactcactgcggccgccctcatttccgatttacccaggccaaaggggactgccaggtggagagggggagcccaggccatcctggggctctgttctcaggcctaggggccaggatcttctgtaagccacccaccccccagctccaggataaggacaccccttccagccaagcgcctggtttaattgggaacggaaataaacggcttacaagaggctacaccagggctctctgtggcccacagggcctggtcctgagattcctgctgcctgcatggcttggccagctacccacgccaggccccgttgactcatttacactggagcagtccaaattcatcaataatgatttgtctctcttcaagaagaggctcgcaatcaaaaggccattaaaattaagtactggaggagcgggggccagggaagggggagggggaagaaaagggggaggggtggggccaggcggagctgagtgtgaatctccactggatgtggacactttcttgttgcgggaccttggatgggtcacgtctcgtcctggtttcctcttctctgaaacagaagggcagatatggctacagtatcagtgacactgtgtatggaaacacccagcaggaagaagcacgaagtgaccctgctatgaggcttccagcattgggacacatggggaaggtgatggatactgagcaggggtaatgccagcctgctaggtcagatcccagggcagctacccctcactgcccagctgtcctaactccagcccctgagtaactacccattgccacctcaactgggctcaacaccccagggcagggccacagctcggccctgctctaatctctgggcaggagcagcagaagcatcaggacacccaggacagccctagaccttggaagaggctggaccagacagggctccccagccctcagcagcctctcagccctcagccttccccctgccatctggagcatggcatctcaggatgcctcaggcacagagaggcgaccccagtgtcccacacccaccaactgaccctcctactgccctgggtgttaagaggccaacgtgcagccttcttttgggcacccagacagctaacatggagtcctatgcatgggtggctgagaaatgcaccactgtccccaccctgcctttctcaagaaataaaacacaaacaagaacaaagaaagaaagcaaaaggaaaaaaaaatggaattctgcagcccatcccacaaggtccaggccttccttgggagaaggggaggtgccaagaactccagatgtgttgatccctgggtttgcacagccatctgattcttcttgaggacaggaaatgaaattttacaaaggtgcccattatgtgccaagcgcttgttacttcatagaacaaccacaaggataccacaaggttggtattagtcattcttgtttttaagggagaactcagaaagatgaaaagccttgcccaaaatcacgagtctcagaccctcacggtgccaaagccaagattcaagcccaggaacagcagatcctgactcgattcttcctccacgcttccacatggccacccgagcacctgactctaggtccagttccagtgtgggctggaaggagcctctccatgctgatgccaatcacaatcatggccactacttcccatgcgcccctgggtgccaggctgcagctccaaaggttggagtcactccatcctccccaaaacttaacgaggccaggattctcattcccatttcacaatgaagacgctgaggcacagcgatgttaaatgacctgtccaaggtcacaggataaagtcatggcagagccaggtctccacctgatgggctgaaaaccgcacaagggccagggtagtgcccagctttgctcccacctgggccccacagagtgacagctcagcaagtgtgtgctggatggggagactggtagagggagggaaggaaggatggacaggtcagcacagccgtggaagagaatggctaagaggtgacactcagagccaaactgccagggctcaaacctcagctttgccactttttacctgcaagtttcttaatttgtccctacgtcaattttcttatctgaaaaatgcagataataatagttcttactagctagggttcttaagagaaacaagtgagttcatatggagcctgggacatggtgggtgccctacactattgtggattagtggaggacaggcaggtctaaagccgtggactggcggcagcccaaccacaaggtgtcctcatgaggcctccagtgaggtcagccccacccttgcacactgagagtgagcgcctcctgagcacctcgctggcctcacctaaatcccttccaaccctggtcagcccatgactttccatctgggcttccccagtcccgcagggtccagttgccccaacccagaggacagagacgctcagaccagccccgaaagcgtctccagcctggtaacagtgagcaccccatctctgagaggttaaagcagagtgggacggccacctggggacctgcagacaggcttctggctgggaaggagactggaagccactttgaagctttgtgccggctgagcattaccggcgcgaatggccacagcgccacctggtggaaatataagaaatgacctaaggggccccagagggtggaacacaagcagcatcctctccgagtgggacaggccccagcccaggtgcttctcacaacaggggtacttggacattcaacaaataaatgaggccccaataccaagcactttggtgcgttgttttcacgcgctataccatttaattctaacaacactctaaggaaggcatccttaccctttttacaaataaagacattgagctcggagatgcaacgtttatttgaccaaggtcacacagctagcagtggcagagtcaggatttgagctctcgaattctgactccacagcctgccctcctaattgctaagccttgggggattccatgagaaagaaaaccagcacccctcccctgtcccaccccttcgtttcatggagcttacacctagtcaggggaacagacagaaatcagaaattcactgactaggtaccgtgtgtcaggcactgggctaagttctagcaataccgtggtgaagagggtggtcagggtccctgctcaaatgaatcctgtggggaagaaggacattaaccaaataatcacacaaatatgcgactataacgggagacgtaaaggaaagatttgggttctgagacccactgaccaggcacctactgcgctgaagcagtaacatactgagctgagagctgaaaggtgaccaggacttacccaggaaaagacgcacttattcattctttgacaaatgaaagcactgtgtgttccccatggtgttttcctcttttgttacaataaataaatagactgtatatacgctattgcaacttgcatgtataaataatagactgtatatatgctattgcaacttgctttctaagtctacatagttttttggttctttgcatggcaatacacagagatcatttgttttaactaaggaggctgtcacacaactgacatctgccttatgcaccacgatgtatttatctgtgcccctgctgatgacacttgagttgtttccaaattttaactcctacaaactgctacagccacatcctccaagtccatagtctctcaaagtgcatgcatatgagttcccctgtggtaagtgcccatgttccctttaatacttgtcaacatcattttgctggagaagagaagaaaaaaaaattttttttttttttttgagatggagtctcactctgtcacccaggctggaatacaggggcgtgatctcggctcactgcaacctccacctcccgggttctggcgaatctcctgcctcagcctcctgagtagctgggattacaggcacacgccaccatgcccagctaatttttgtatttttggtagagatgggatttcaccctattggccaggctggtctcaaactcctgacctcaagtgatctgcccacctcaacctcccaaagtgctaggattacaggcacgagccagtgcacctggccaaaaataattttctattactaataagtttatacaaaaacaaattcattcactagttcatttaccccagctgaagccaagttaaggatctaaaacacatttgccaaaatgcttcccacttttctataggccttattctttcttcggttttcttttataatttttctaagacactacttcttaagagatacatgtaaagggttctaaatttcatttcttaaaaaaatcacctgtctcataaacattttgcattcctaatttcaggatttcagctgaccactccatggccttcaggctggctcatctgagggttagtggcacctccatagttacaccatataacttgcagacacataccttcttacagataggtgaggactgggaggaatggcctacatttctttttttttttttcaacttttattttaagttcggggtacatatgcaggatgtgcaggcctgttacgtaggtaaacgagtgccatggtggtttgttgcacagatcatcccatcacctaggattaagcccagtatccattagctattcctcctgatgctctccctccccccaccccatcgcataggccctagtgtgtgttgtttccccccaaggtgtccatgtgttctcatcattcagcttccatgtataagtgagaacatgcggtgtttggctttctgttcctgtgttagtttgctgaggataatggcctccagcttcatccatgtccctgcaaaggacgtgatctcgttcctttttatggctgcatagtattccttggtgtatatgtacctcatgtctttgctgttgtgaagagtgctgcaatgaacatacgtgtgcatggtctctttataatagaatgatttctattcctttgggtatatacccagtaatgggatggctgggccaaatggtatttctgcctctaggtctttgaggaattgccacgctgtcttccacaatggttgaactaatttacattcccactaacagtgtaaaagcattcctttttctctgcaatctcgccagcatctgttgtttttttactttttaataatagccagaatgatttaagtcgatatccaagggtggaccagttcccatgtttcccagcctgtgaggagtctcctgtgaaaatctgagctagccagcactatatttcccatcgatgcccatcatgtgttatggcccctgacctgggctgcaggtgcccgagtaaactgaaggtttccagggtgtcaggtctagaggagacatcgtcagcactgaccttgaggcctgtgaagcccatggtggtctctttggaggaggatgagggttagggcagggtggctgcccagttcccaataacagccctttttctggaattgcccttgattctcagaactatggtgaacctggccagtgctaggatagtgaaaggcaaaagggactctatggcccaaacttgccaccatctctaccaaatttattctctgggccctctctattgtccactttgtcaggagctgagatgagctgagctaaacagggtggaactgaaagtcgagaccccaagagaggaggcatctgatccaacagcagttccgaaatctgccaccaggtaacagcagagctcctgctctgtctctggtctctcactggcatggggtcccctgggactctgatctgcacccaggcttggccttgagggtcctctgcttgtctcaactctgcaattcattgtgagcctccagtccccatcaaaaagcaccactagcaggataagattctgtggtctgttggggcacagggactgtcttgtgccccctggaagtctgtttccaaaggatcctgttcatttcacaggaggcctagggcagggctaccaggcagctctggaaaacccaggagacaacacagggcagctcaggttgccactagagagaggattctagagcccaataaagtgtccctgctgctgtcccctcatctgtggccacaaggccttgaaccccgactcagattcactccctgcagccacaggcctgagcccagcccagcctggtaagccgtattctgaaattgttaaagaaaaagatgaaggcctgagggctcgcagtctggggccatgtgccaagccctgccttctcccgtgcccatcattccaagcagctctgacctcactgaactcaaacaaggactccacaccccaacacccaatgtaccagcacaggagtctccctgtaaggccccagatttctggatgagcatagacccatctgatggcccctaggaggctgtttgtggcctgagttctggtttggcaccctatccatgatcagggcggaccagcctaggtgggaaaatgagacctggagaggttggagaccctgcccaaagcctggggcctgaaacctgaggtctggcaggttcctggctccacactctcacagctccctgtgacaatcccttcattgcgcacatcacaattataattccgtgatgcatatgcttgcatggccttttaatgtcctgctacccgcgtgacctgtaagccccatgaaagaagggactatgttcactcctgtaaccccttgcaactagtgcaatgcctggcacacagtagatgctcagaaaataactggaataagtaaaataataaagggacatcctcctaaaggagaccttaagacatttataaaatgttttacaatttacaaagcaccccccacagttttccagtttcattctccccaccaccccgtgaaataggtactattaggctgggtgcagtggctcacacctgtaatcccagaactttgggaggctgagtgggtggatcacctgaggtcaggagttcgagaccagcctggccaacatggtgaaaccccgtctctactaaaaatacaaaaattagccagccatggtggtggaagcctgtaatcccagctactctggaggctgaggctggagaatcgcttgaacccgggaggtggaggttgcagtgagccaagatcgtgccatttcactctagcctgggcaacaagagcgagactctgtctcaggaaaaaaaaaaaaagagagagagagagagaaataggtactattattgcccacataatgcagtgtactcatttcctatctctgcaacaacgaattaacacacacagtggctaaaacaacacaagtttattttctgactggaggtcagatgtccaacccaggccctatgggctaaaatcaaggtgtcagcagggctgtgttccttctgggagctctcaggaaaatctatctccttcctttctccagcttccagagaccacccatgtttcttggctcatagtcacttcctctagcgtcgaagccagcaatgtcacatctctcttactgaagccagaagaggttctctgtatttaaggatgcctgtgattaggttaggcctacctgcataatccgggataatcatacattccagacattaggatacacacatctttttttttttttttttttttttttttttggtggtggtgagcggggagagatgttatcctgcctaacacacagagattcacagagattcataaacggagaggtgaattaaccagcccacctcgcccagcttgtgactgaagtgagatttaaagccaacattttggggctacagaatctgagctctttctccccttttccagagccagaagggaaggacacaggggcccagtctccatacagtaaatacacattttattttattttattttatttcattttttgagacagggtcgcactctgacccccaggctagagtgcagtggtacaatcacagctcactgcggcctcaacctctgtggctcaagtaatcctctcacctcagcctcctgagtagctgagactacaggaacacaccaccacacctggctaatttttttttatttttttgtagagacagggtctcactttgttgccaacactggtcttgaattcctgggctcaagcactcctcctgccttagcctctcaaagtgctgggatcacaggtgtgagccactgtgccagcccacacttttatttatgattaaagagaaagaaaaaaaaaaagatgcgcttgtctggagggtgaggccgtgtgggaaaactttttatttgcttgcctttattatcattactttaacggtgtatttaataaatacaacgttttcagctagagggaaaaaggaattaacccaagtcattggttgagtatgaaggcatggagcccccacggccctcctcgctgcaattaagcaaatggccagcagatggcggggcatgctcacagcagggccttgctctccggaccatctcttttacgggccgccgagcaaaggtctttcttttctcttcttcaaaacccactctacaaggaaatcttcagaaacattccagcaggcaagacaagggcataaaggccagggggtcccccagcctcaggacagcaagtgtggggacgtgccctactgcatgccccatcccctgagccaggaacaaagaccagaggtcaagccggcagcagttgaggaagagggtcaggcgtggctgtgtgtcccgaattggtgggttcttggtctcactgacttcaagaatgaagccgcggacccttgcggtgagtgttacagttcttaaaggcggcgtgtccggagtttgttccttctgatgttcggatgtgtttggagtttcttccttctggtgggttcgtggtctcgctggctcaggaaagaagctgcagaccttcgcggtgagtgttacagctcttaaggcggcacgtctggagttgttcgttcctctcggtgggttcgtggtctcactggcttcaggagtgaagctgcagacctttgcggtgagtgttacagctcataaaggcagtgtggacccaaagagtgagcagcagcaagatttattgcaaagagtgaaaaaacaaagcttccacagtgtggaaggggacctgagtgggttgccactgctggctcaggcagcctgcttttagctgcagggcagcggaaggcaggatcagctgggttacaggacacttaggatgaccggacactttacacgcttttacacacatttatcattacatctcctcttccttgtggcccagtatggcacctggcatcaaaaatactgaactggctgggaagatggttggtagcaatgccagcgcagtttttgaacccctccaaatttctacataaaaataagcaggtcaggtcaggcgcaatggctcacacctgtgatcccagcactttgggaggccgaggcaggcagatcacctgaggttaggagtttgagaccagcctcgccaacatggcgaaactccatctctactaaaaatacaaaaattaactgggaatggtgatgcacgcctgtaatcccagctacttggggggctgaggcaggagaatcccttgaacccgggaggtggaggttgcagtgagctgagatcgcaccactgcactccagcctgggcaacagagtgagactctgtctcaaaaataaaaaataaaaataagcaggtcagattagcaaaagcaaaacctacagacaatgttcgcttaaaattagatgataaggtatccccatgaacaccaaaacacaagcggggaagcacagccctcccatagccacctacatgtcatcaggtccccctacgttcccccagggaggcttccttggtttagattctggcccttggtgccccatccagcagccaacagagggaaacaaggagccctctgatggacttaagaacaggagaatcccaaaagagccagcaggtattcacgaggaagcaaggagggacaactggagacagcagcagaagctgggagggtctcgcccagtccgggagcaggtgagagtcagcaaggactaagggactgcagcggtagagccttgagaaccctcaacactgacccacttggcttcccttccaggacaggatcacatagcactgagcatggaatcaaaatggagcaggatctggacaatcaaaaggaaggaaggagaaggccaggcgtggtggctcatgcctgtaatctcaacactttgagaggccgaggcaggcagatcacttgaggtcaggagttcaagaccagcgtggccaatgtggtgaaaccctgtctgtattaaaaaaaacaaaaattagccaggtgtggtgacaggtgcctgtaatcccagatacttgggaggctaaggcaagagaatcgcttgaaccagggaggcagaggttgcagtgggctgagattttgccattgcattccaacctgggtgacagaacgagtctctgacttaaaaaaaaaaaaaaaaggagaaaattcagatagaagcagagggaggaaattaagtcaaggaacctcaggaagcaagccatcacatttttgcacatgaaaaccacaggagagggtactcttgaagttggaaacgccattctgatcatctctttcttcaagtttgggaacactaattccacataaaaactaacaatggaaaagtcttgaggccaaatcccatgcaaagttaatttaagcaaaaggagaatagggagcaaaatgacattcccacaaacagaaaaggcatgccagcaggacatatctcggaagagatcaaaactgtaaccttctattttaaaatgacctaaaatttcaattatgcacaatgtgaaagaacaacataactgagaattagaaactcatataaataaggtgacacaaatcagaaaagaattaaaaacttaagaaaaaaaatttcaggaatgaagactagaaggaacataagagcaaactgatgcaactttaagataatgccttaaaagaaaaaggtgaaaaggaagaaatattttaaatcagtaggaaatgaacgctattttctaaaatcgtctagagaaagtggcaaatattgaaattaggcaaagaagttccaacgtatcaataataagagttcttgaagaagaaaaccaaagcaagaggacaagtaataaaaacaaaatcaagagaacttactgaaatttttaaaaattgaagttacatattgaaagcacatactgcatacctgaaaatatcaactcagaataatcagacatattcaaataaaattacagactttgagaaaagtggggtggtgaggggagaatccttcagcatctatgtaaataattgacttataaggaaaaatcaattattatcagacttctcaagagcaatgctttataccaaaagaaagatgttacatgtttaagatgttcaaaaacaaagaatatgttaataattttatgtccagcaaaactgacttgaaagtataatgggcagaggcaaattgttattagcatgaaatagaggatattgttctcatgggctcttcctgtaaacgtcttagatcaaaagcttcagacaagcaaaatgactaggaagacaaaaaatgaaatttaaaaaactggtaatgaacgttaaacatatagttacttatgcaactaagactaaatgagaattgtaaaggagaaaatatagcaggtaatggctatacaccctgacaatgtagctacaagaccactttttttatttttaatttttgtgggtacatagtggtttggttttgttttgttttgtttttgtttttgtttttgtttttgtttttgttttgagacagagtttcactctgttgcccaggcggttgtgcagtggcgcaatctcagctcgctgcaacctctgcctcctgggcttaagggatcctcctgccaaagctcccaagctgggaccacaggtgcacaccaccatgcccagcttattttttaaggtttttttgtgtagagacaaggtctcactatattgcaggctggtctcgaactcctgggctcacgtaatgctcctgccttggcctctcaaagtgctgggattacaggcgtgagccactgcaccgggccataagtgtatatattaatatttgtggcttacagagatattttgatagaggcacacaatgtgtaatcgtcagatcagggtaaatggagtatccatcacctcaagcgtttatcctttgtgttacaaacaatccaattactcttttagttatttttaaatgtacaactattttttatgatagtcaccctgttgtgctagcaaatagtaggtcttattcattcttcctaattttttgtacccattaaccatccttctactctgtgtctccatgaattcaatcatcttaatgtttagctcctacaaataagcaaaaacatgcagtcttttttttttttttttttttttttttttttgcagcagagtctctcactgtgttgccaggctggagtacaatggcataatcttggctcactgcaacctccgcctcccaggcttcagcggttctcctgcctcagcctccagagtagctgggattacaggcacgcgctcctgaacccaactagtttttttttatttttagtagagatggggtttcaccatgttgcccaggctggtcttgaactcttaacctcaaatgatccaaatgatccactttggaagcctcggccttccaaagtgctgggattacaggcatgagccaccgcacctagcccgaagtttgtctttctgtgcctagcttatttcacttaacataatgacttccagttccaaccatgttgttgcaaatgacaggataccattctttttatgactgaatagtattccattgtgtatatgcaccacattttctttatccactcatctgttgatggattgcttccaaatcttgactattgtgaatagtgctgcagtaaacatgagagtgcaaatatctctttgatatactgatttcctttgttttgggtatatacccagcagtgggattgctggattgtacggtagctctatttttagttttttgaggaacctccaacttgttctccatagtggttgtactaattaacattcccaccagcagtgtacaagagttcccttttctccacatcctcaccagcatttgttattccctgtctttgggataaaagccattttaactggggtgacatgataactcattgtagttttgattggcatttctctaatgatcaatgactttgagcaccttttcatatacctgtgtgctatttatatgtcttcatttgggaaatgtctattcagatattttgcccatttttaatagaattattaggttttttcctatagagttatttgagctccttatatattctgttattagtcccttgtcagatgggtagtttgccaatattttctcccattctatgggaggttttttgagggttttttttatcatgaaggctgttgaattttatcaaatggtttttcagcatcaattgaaatgatcttatgatttttgtccttcattctgtgattctatgattctatgggttgtctatgattctatgggattctatgattctgtgattctgtgggtttctcttcacttgttgattgtttcctttgctgtgtagaagttttttttaacttggtgtgatcccatttgtccatttttgctttagttgcctgtgcttgtgggttattattactcaagaaatcctttacctctccaatgtcctggagggtttcctcagtgttttctttttgtggtttcatagtttgaggtcttacatttaagtctttaatcaatttggatttgatttttctatgtggtgaaagataggagtctagtatcattctcctgcatgtggatatccacttttcccagcaccatttattgaagagaatgtcctttccccaatgtatgttattggtacctttgccaaaaatgagttcaccctagatatatggattcattcgggagttctctattctgctctactagtgcatgtgtctgtttttatgccagtactatgctgttttggttcctatagctatgtaatataatttgaaggcaggtaatgtgattcttccagttttgttcttttcgctcaggatcgctttggctattctgggtcttttgtggttccatataaattttaggattgtttattctatttctgtgaagaatgtcattggtgttttgatagggattgcattgaatctgtagattcctttgggtagtaaggacattttaacaatattgattcttctaatccatgaatatgaaatatctttccatttccttgtgtcctcttcagtttctttcaccactgttttatcattttaattgtagagatctttcacctctttggttaagttaattcccaggtattttattttattcgtggcaattgtaaatgggattaatttcttgaattctttttcaggttgttcgctgttggcaaatagaaatggtactgactttggtatgttgtttttgtatcctgcagccttattgaatttgtttatcagttctaataattttttggtggagtcattggattttttcaaatataaagattatataatctgaaaacaaagataatctgaattctttctttccaatttcgatgccctttatttctttctcctgtctgattgttctagataggatttccagtactatgttgaataacagtgatgaaagtggccatccttgtagtgcttcagatcctagaggaaaagctttcagtttttccccattcagtatggtactagctatgggtctgttgtatatgggttttattatgttgaggtatgtccttctatacccaggttttttgagggtttttatcatgaagggctgttgaattttatcaaatgctttttcagcatcaattgaaatgatcttatgatttttgtccttcattctgtgacatgatgtaccacattgatttatttgcatatgttcaaccatctttgcatcactgggataaatcctacttagtcataaggaatgatctttttaatgtgttgttcaattttggttgctagtattttgttgaggatttttgcattaaaattcatcagggatattggcctgtagtttttgttttttgttgttgttgtttgtttgtttgttttgatgtgtctttgtctggttttgctatcagggtaattctggccacatagaataagtttggaagtattcctccctcctctattttttggaagagtttgagtaggattggtattagttcttctttaaatgttttgtagaatttagcagtgaagccatctggtcccaggattttctgtgctgggagactttttactacagcttctatttcattactcattacttgtccattcaggttttgttttttgttttttgtttttgtttttgttttgagacagagtctcgctctgtcacccaggctggagtacagtggcatgatctcagctcactgcaagctccccctcccaggttcacgccattctccttcctcagcctcctgagtagctgggactacaggtgcccgccaccacacccagcaaattttttgcatttttagtagagatggggtttcaccgtgttagccaggatggtctcaatctcctgacctcatgatccgcccaccttggcctcccaaaatgctgggattacaggcatgagccaccgtgcctggccaggttttggatcctcatgattcaatcttggtaggttgtatgtatctagaaatttatccatttcttctagattttctaacttattagcatatatttgctcatactagccattaattatcctttgaatttctgcagtatcagttgtagtatttcctttctcatctctgattttatttctttgtcttctctcttttattcttcaattgtctgtctaaaggtttgtcaattttgtttatctttcaaaaaaactttgttttgttgatcttttgtattgttttttgtttgtttcaatttcatttatttctgttctgattgttaatatttcctttcttctactaattttgggtttggtttgcttttgcttttccagttctttaagatgtatcattaaattgtttatttgaaatttttcttcttttttgatgtaggtgcttgtaactataaatttccctcttggtactgctttcactgtatcccatagattttggtatgttatgtttccattatcatttgtttcaagaaattttctgatttcctctttaatttcatcattgacccactggttattcacgagaatattgttaatttccatgtgtttgtatagtttccaaaattcctcttgttattgatttctagttttattccattgtggtcaaaaagatacttgatatatttttcaaatttttttaatgttttaagatttgttttgtgatctaacatatggtatatcattgagaatgatccatgtgctgaggaaaagaatgcatattctgcagctactggatgaaatgttctgtaaatatctattaagtccatttggtctactgtacagattaagttcaatgtttctttgttgatttttctgtctggaagatctgtccagtgctaaaagtgggatgtggaagtctccagctgttattgtattggagtctatctctctctttaggtctaatagtatttggtttatatatctgagtgctccaatgttgggtgcatgtatatttacaattgttatatcctcttactgcattaactcatttatcattatatagtgaccttatttgtctcttcttatagtttttgtcctgaagtctattttgtgtgatataagtatagtgactcctgctctttttttggtttaagaggcatggaatattattttccatccctttattttcagtctgtgtgtgaagtatgtttcttgtaggcaacagatcattgggtcttatttttttaattcattcagccactctgtgtcttttgattagagaatttagtccatttatatttaatgttattgataagtaatggcttactcctgctattttgtcatttttgttctgtggtcttctcttccttctttccttttttttctgtcttcattttagtgaaggtgattttctctggtgatatgatttaatttcttgctttttattttttgtgtatgcattgtatgcttttgatttgaggttaccatgaggcttgcaaatactatcttatcacccatcattttaagctgatagcaatttcatagtgcttgcataaactaataagcaaaaagaaaactaataaagactctacactttaatttcatccccctgcttttaactttttgtttcgatttatgtcttactgtactgcctatgtcttgaaaagcttttgtagtcatcatttttactggttcatctcttagtctttctacttaagagcagtataacacactacagttacagtgttataacattctgtttttctgtgtacttactattaccagtgagtcttgtaccttcagatgatttcttattgctcattactgtcctttactttctgactgaagtattgcctttagcatttcttgtagaacaggcctggtgttgatgaaattcctcagcttttgtttgtctgggaaaatatttctctttcatgtttgaaggatattttcatctgatatagtattctagggtaaaaggcttatttttcttcagcactttaaatatgtcatggcatgctctccagtcctgtaaggtttctactgaaaagtctgtggccagacatattggaactccattgtatgttatttgtttcctttctcttgctgcttttagggtcctttatttatccttgacctttgggagtatgattattaagtggcttgaggtagtctttgggttaaatctgcttggtattctataaccttatcatacttagatattggtatctttttctaggtttgggaagttatctgttattatccttttgaataaactttctacacctatctcttatctacctcctctttaagctccgtaactcttagagttgcccttttgaggctattttctagatcttgtagatatgccttattcttttttattcttttttcttttgtctcctctgactgtgcattttcaaatagcctgtcttcaagctcactaattctttctctgcttgatcgattcaggtattaagagactctggtacattcttcagcatgtcaattgtatttttcaactctagactttctgcctgattctttttaattatttcaatctgtttgttaaatttgtctgatagaattatgaattccttctctggtttttcttacatttctttgagtttcctcaaaatagctattttgaattatctatctgaaagatcacatatctctgtctctccaggattggtccccacgggcttatttagtttgtttggtgatgccatgttttcccggatggtcttgatgcttgtggatgtttgtcagtgactgtgcatttaacagttaggtatctgttgtactcttcacagtctgggtttgtttgtacttgcctttcttgtggacaggtacaaacaagcccagactgtgaaggacaagtattgtggaaggacaaggctttccacgtattcaaagggacttgggtgttgtgatctaagtgtttggtcactgcaaatgcatctgcattaagggacaccccaagcccagtaatgctgtggttcttgcagagttgcagaggtaccactttggtagccttggataagatccagaagaattctctggattactagagattcttgttctcttcccttactttcttccaaacaaatggagactttctctctctctctctctctctgtgctgtgctgcctagagctgggggagaagtgacacaagcacacctgtggtcaccatcactgggactgcgctgggtcagacctgaagccagtgcagcattaggtcttgcccaaggcctgctgtaactgccacctggctactgcctatgtttgctcaaggccctagggttctacaatcaggaggtggcaaagccagccaggcttatgtccgtcccttcaaggcacccagttcccccaggccccaagcaggtgcagagatactgtctgggagccagagactggagtcaaaaagcttagaaatctacctgctgttctattctactgcagctgagctggcactcaaaccacgagacataatccttcccacacttccctcccacttccataagcagaggggcctcaacctgtggccatcaccacgacaggcccataggactactgccagtctaccaccaacgttcactgaagacccaagggctcttcagtcggcttgtagtgaatgttgccaggcctgggactcatccttcagggcagtgggtttccttcccacccagagcaggtccagaaatggcatctaaaaggcaaggcctgaaaccagggaccccaagaaccctctttatggtctagtctactgtggctgagctagtatctaaggtataagacaaagtcccctttactttttcctctgctttactcaagcaagtgttctcactatggttctcaccatagccaccacagctggaaatgtgctgggtctcacctgaagccaacatgtctcagagtctcaaccaaggcctatggtagataccagggtatcgctgctggttcttcaaggtcccaggactctttaatcagcaggtaatgaatcctgccaggactgagtccttcccttcaaagcagtaggctccctcctagcctagggtgtgtctagaaatatcatccaggagctaggccctggaatggggaccttatgaccctaactggtaccctatcctactgtggctgagctggcatccaagatgcaagacaaagtcctctttactcttccctctcctctcctcaagtggaaggagcttgcacagctgcaagctgtgctacctggagttggggggagggtggtgcaagtactcccttagctgcctcagctagtgtctcagtaggtcatgtgcccccaccatgtccactgactctgagcccagctcagcactaggacttgcctaggaactgcagtccttgtgaccttgactgccattcaagtttatttacaacccagagcattttacccccatggtggtaaggcttgctgaaactcaagttccatccactgggttgggcaattcccttgggcaattaccctctggctagggctggtctaaatactctctccatcatcagctgtcagctgagttcagttcggttttgctttcactgtgacaaagcagcatcaaattcaatgcaatgtctcacaatagctgcgctctccctcttccaagcacagagattctctctctacgccacaaagccactgccatgggatggggacaggtggcatcagcaactcaagactgtcttccctaccctcttcattgcctctttcaacagtatgaagttaaaatcaggtactgtgagtgctcatccaattgttggttcttatgatgaaggtgcttttttgtgtgtagatagttgttaaattttatgttcctgtgggggatggggagatggagccttctattcagccatcttgctccacctcctacaacggcagtccccaaccccctggccatggactggtactggtctgtggcctgttaggaaccacgctgcacagcaggaggtgagcagcagacaagcaagtgaagcttcatctgtatttacagccactacccatttctcattaccgcctgagctgcacctcccatcatatcagtggcagcattagattcttatgggagtgcgaaccttattgtgaaccgtgcatgcaagggatatagttgcgggctccttgtgagaatctaatgcctgatgatctatcactgtctcccatcatccccagatgggaccatctagttgcgggaaaacaagctagggctcccactgattctacattatgaagaattgtataattatttcattatctattacaatgtaataataatagaaataaagtgtataataagtgcaatgtgcttgaatcatcccaaaaccatcccttaccccaatctgtggaaaactgtcttccacaaaaccggtccttgatgccaaaaagcttggggaccactgccctacaagaccacttttaaaataggaataatgggaagaccatattcaaaaaaaaaaaaactttttaaactgtttccagtaattattttgttgatgctattactgctgtcattttgagaccattgcgtgtgtaatgtgggataaggaaaataagcaattacagactgttttaattctatcatctcctgtattattgaggatctgattctcaatatggaagaaaggagagatgtaatatagaaaagattaagtgaaaaacctaagtgtgaattggaattattagtatgaacacagggtgctatcctcctggtttctggctgaaaggtgtgtgtgtgataaaatatatttcctaatgaccaaatcagtagccatctgcatccctagcatccagacagtggtcatgaaaccctattttccatttaaaaataaaacggggcccggcacagtggctcacgcctgtaatcccaacactttaggaggccaaggtgggtggattgcttgagcccaggagttcaagaccagcctgggcaacatggagaaaccccttctctacagaaaatacaaaaattagctgggcatattggtgcatgcctgtagtcccagctactcaggaggctgaggtgggaagatcaactgagcccaggaggtcaaggctgcagtgagccgtaatggcaccactgcactccagcttgggtgacagagtgagacctcatctcaaaaaatatataaaaataaaaggacttgtagtcagttaatatttattcagtatttcaatcttgtaaatataaatatttacaagtaggtttcactgtcctctcctgatggatgacaaagggaaaacacagagaagaaagcagttttctcagggccacacagctgctaaactgcccagctgggcttgaaacccaagtgaggttcatctgttcattcaacaaatagttgctgacacctgctgagtttactgctagggaaacagctaagttaaaacagcctgacttcccatccacctgcccttcctgtgagaaaggggaagatggacatgcaagggacacttgctggtcttggtacccacttgggcacagccccagcacctgtcccctgtgcaaagccgatgtgctgctctcagaagtggtagctaagcccacgccctttcacccccagctctgaagatgacaatgcattcaaattcaccagatcacccccagctctgaagatgacaatgcattcaaattcaccagatcacccccagctctgaagatgacaatgcattcaaattcaccagatcacccccagctctgaagatgacaatgcattcaaattcaccagatcatctaatgaagtttcacttctgtttcttagcacctccctgactcttctgttccctagagtggaaggagggtctgggaaaggacctttgcctgaaactaagaagtcaacatgatacccctcaatatcccacctgggaagggagctgccaatgagccgaagcagatggggaggagatgaaactgggctatcagctttgcaggctggagccccctcctgtatctgccttatcttctggtatccccagcacttggcccttggccttgtagaaagcaggaatgtgatacatgtttggtgaatgaatgagtgaattaattaattaatttaatatattaatttgtatctatttcaaatagagtctgaagctcaattaatactttaaaaatacagctgggcatggtggctcacacctgtaatcccagcactttgggaggccaaggcgggagcatcgtccaagagtttaaggctagcttgggcaacatggtgaaaccccatctctaccaaaaatttaaaaaaaaaagaattagctaggcatggtggtatgcgcctgtagtcccagctactcaggagactgaggtgggggaatcacttgatcctgggagggtgagactgcagtgagctgagatcacggcactgccctccagcctgggtgacaaggtgtggccctgtctcaaaaataaataaaaataaaaatactatataatcattcattctaaaacagaagttataatcatgcctatccctagggccattgggaagattaaatccatgaataaatgtaaaacacttagaccagcgcctggcacataccaatcccgcaataagctattcatgtaaactgagagtaggttgtcccactccatgtgggattaggggtcagtgtaggaccagggtcagagatcaaggggagaatcacgcaaaaatttagtatgaagttaggattagaggaccagtttgtgtccacccagcagtcagattttttagttaccatctatttgtttatttatgtcccacattgttccaggaggagtcaaggcagctttcaggaattctaactacagaaatcaagaaagagaaagatcaaagttactatggactgaatgtttgtgtcctccccaaaattaatatgttgaagcctaatccctaatgggatggtattaagaggtgagacctttgagaggtgattacgtcatgaaggtggggctctcatgaatgggattagttcccttttaagaagaaacataaaaggaaaaaaagaaagaaagaaaaaaagaaaaaataataaaaagagaagaaacgtaagagagacctctctctctctctttcaatcaatcaatagctagatctccccctctctaccatgtgaggatacaacaagaacacagccctctgcaaagcaagaagagtgtccccaccagatactgaatcttccagcaccttgaacttggacatctcagcctccaaaaccatgataaataaaattctgttatttcagccaccgagtatgtggtattctgttatagcagcctgaactaagacgaaatggaggtgttactccccaagggtactcatgctggcaccctgaggccttctcagcacagagctgcaaatgggcaaccaaatctcaggccttgctggtcattctgaaggtcacactgacagcctatggtcaagcagagccagctgcacgaagtcctggtaagaattccatgagatcccccatgcaaagtgttggcacagagtaagttctcaacacatgttgctattgctatcagtgcacaggctgaggtgaatgcgcagcgagcagcagggaccagcattttatcactggccagagcagtgcattctctccccatgagcagccctggattcagagccagaaaaagtggatgttcaatggcatcagattgggggagccaaataaattccacggggccaccctgaccagcagctgtagagatactggaagtctgttggctacaaccctctctcctcggaatgtgcctggacaggctctggcagctctgggctctgaatgaccaaaccccagcccaccagacatgacttttccctatatagctggatatatttggctagatgaggacaagtccacaaggcatatttcaaatgtggagtgtgtgtgtgtgtgtgtgtgtgtatgtgttggggggttgtattcagttcccattgctgctgtaacaacttaaccacttaaacaatacatagtattttacagtcctgcaagtcagaacagggcgaaaaatcaaggtttccacagagccgcattcttcctggaggctctagggtaaaatgtgttccttgcctcttccagcttctaaaggccgcccacattccatagacttgtggcccttatccatcttcaagccagccattgaatcactctaacctttgattctactttttgttgttgttgttgttgttgttgagacaggatctcactctgtcacccaggctggagtgcagtggcgcaatcacggctcactgaagtcttggcttcccgggcccgtgtgatcctcccacctcagcctcccaagtagctggacttcaggcatgcaccaccacacccagctaactttttgtattttttgtacagacaggatctctctgttttgcccaggctggtctcaaactcctggactgaagcaacccacctgcctcagcctccaaagtgctgagattactggcatgagctaccatgccgagccttgacctctgactctatcatcacgtctctttctctgactttcatcctgccttcctcttataaggaccttgtgattacactgggcccagccagataatccaggatcatcttcccgtctcaagatcattagcttaatcatgtctgcaaagtcccttgggccatgttaaggttaaagtgtttgcaggttccgggagttttgatgcaaaatatctttgggggccaagcttctgcctgccccaggggcctagtgttataaactcttaagatgctgtgaatctcctgccctctgctctcccaagagagggactctggagccaaaaaaacatttctaagtccagaaagaattttggcaaaatgtcccatcagaagataaaggaaaggggtgaattatctctttgggtctttccagactgagcaagatattattcacctgtgttgcccatccggggtccagggtaaaagacagcagccagtatccagcttcacctgctgggagtaacccaggccacgaaagacttcttacctccttgctcacttgtgattcaaaaggccatttctttacctcctgagatggcccaaagaagcaatggcccagggaccattttggggagctgccttctagatctgcagaaagtataaaatggttccaagcaaagaaacactggacttcccggggttccagatccaccttccacatcagagccccaattcccactttaactgacttgctggcactgtgtctctctgtgtgccccagaagaaatttcttccaaatcttaataataggaataggcattttctctggggggaaactgttctgctttttacctgacaagctttatgaatcatgtgatggattacatttcccttttcacaatggctgctaggaagctcagagtcagatttgtggcccatggtttccaactacctaggagtctataaactgcattgcttgcactaacctctcccttgattgctcttagctttcttctcccatttcccctttgtccctgtttcttcatccccctattttttactttttactcttgaaattgttagtccttgagatgaaatagaaatgagggtgacaagattgcctttgagagttaaatgcagttaaatgttgttaaatgctgggatcagccaagcctgtccagagcaaagaagtgaaaagtctccaggtggagacagaacagctttcaggtaccaatgtttgattgtaacctgggtttgatgtggtccctagcagggtctccattccccagtctgtcttcctctacacactcctgcctagtgattaatagaccaggttctgatcttggtatttgaccacttcctccttcagactatgaaggttgaccacttccaaggtatgtgtttcctgtaagcagagacaaaaatcagcctgtcatttaaataagagaaaatgtatgacttttagctaaaataattgttttggccaggtgcggtggctcacacctgtaatcccagcacttcaggaggctgaggcaggtggattacaaggtcaagagttcgaaaccagcctggccaacatggtgaaaccccgtctctactaaaaatacaaaaattagccaggcatggtggcaggcgcctgtaatcccagctacttgtgaggctgaggcaggagaattgcttgaaatcggaaggtggaggttgcagtgagccgagatcagaccactgcactccagcctcggcaacaagggtgaaactctgtctcagaaaaaaaaagaattgttttacaagtatgatacttgattggttgccagttgtggaggcttctgcacactggcagctggagagtctcctggtcatttctgcctcatccatcctgcatggtctccatgcctcggagcccagacacagtgccaacaagtcaggtaaagtgggaattgggactctgatgtggaaggtggatctggaaccccgggaactccagtgtttctttgcttggaaccattttatactttctgcagatctagaaggcagctccccaaaatggtccctgggccattgcttctttgggccaaataaacaaacactgtgctcagcaagatcaagacaaaattcagcaactagtttcctaaagctgtgtcttataactctcttcaattaatactctgtgtgtgtgtgtgtgtgtgtgtgtgtgtgtgaatataatataaatgtatgtgtaggtatatacacacttctaggcacagaaatgcctacctatgttcaccaatggacatatgctacaagagtagtacactagtatactcttgtatattactcatgtatatatatatatatatatatatatatacacatagatataaaacaaataatgctaaatcccaatttagcaaaaaaattacttcctattgaatcttccaagcttaagtgcaacaaaatgtctgatcagataagagtttttggctgggcacagtggctcatgcctgaaatctcagcacttgggaaggctaaggtgggtggatcgcttgaggtcaggagttcaagaccagcctggccaacatagtgaaaccccatctctactaaaaatacaaaaatcagccaggcgtggtggcatatgcctgtaatcccagctactcgggaggctgaggatggagaatcacttgagcccatgaggcagaggctgcagtgagctgagactgccattgagctccagcctaggcgacagagtgagaccctgtctccaacaaaaaaaaaaaaaaaaaaaaagagttactaagaataagcagttaagtgatagaaggagtcccttatgagtttatgaatttgagagatttacaaatttttgcttaaatgactaaaatcttttatttgggttttagaaatgttgagctggatcccttttcagtgtcaattataagatagcagggccagttccattaaaatcccttccatttattaataataaaatcaatacatctgcacataagctcatctgcattgcaggcccatccaagagtgatatcatcagtacacatcatccagaaagtctacagtagaaaagacaaaaagtctagaatgaatactgtaatggtatggaacaactggaattggcataccctgagtggggcatgtaaatcggtataactacttcggaaaactatttattagcaactaatgaagctaaatcaatacaaaacccataacccagcaattccacttctaggtacagagatgcctaagctctgttcaccaaatgacatatgctacaaaatccatggcagcactacttacaataaccttcaaatggaagtacccaaatgctcattgacaatagaatagataactaagttgcagtataaattcacacagtaaaatacagctatccctcaatatccatgggggattgattccgggactcccacagatacaaaaattcaggaattctcaagttttttacataaaatggtgttgtatttgaatataacctatgcacatcctcccataaactttaaatcatctctagattgcttataatacctaatacaatgtaaatgctatgtaaatagttgttatactgtgttttaagaaaataatgggccgggtgcagtggctcatgccgggtgcagtggctcatgccagcactttcggaggccgaggcggacggatcacgaggtcaggagatcgagaccatcctggctaacacagtgaaaccctgtctctactaaaaatagaaaaaattagctgggcgtggtggcgggctcctgtaatcccagctactcgggaggctgaggcaggagaatggcgaacccgggaggcagagcttgcagtgagccgagatgcaccactgcactccagcctgggtgacagaacaggactctgtctcaaaaaaaaaaaaaaaaaaagaagaaagaaagaaagaaaagaaaagaatgacaagggctgggggtggtggattatgcctgtaatcccagcaactttgggaggccaaggcaggcaggtcacctgaggtcaggagttcaagaccagcctggccaacatggtgaaaccctgtctatactaaaaatacaaaaattagccaggcatggtggcagatgcctgtaatcccagctcactgggaggctgaggcagaagaatcacccaaacctgggaggtggatgttgcagtgacccaagattgcactactgcactctagcctgggtgaaagagtaagactccgtctcaaaaaaaaaaaaaagaatgacaagaaaaaagtctacatgttcagtatagatgcaacttttttaaaaatgtttttaatctgtggctggttgaatccatggatgcagaatccatggatacggggggctgactgtgcacaccaagtataaccaatcaacaaggacgcatatcaatgtggatgaatttcaccaacatgacattgggcagaagaagccagacaccgaaaagaatatacacagcgtggccaacatgatggaaaccctgtctccactaaaaatacaaaaaattagctgggcgtggtggcgcacacatgtagtcccagctactcaggcacgagaatcacttgaacctgggaggcagaggttgcagtgagccaagatcataccactgcactccagcctaggtgacagaatgagaccctgtctcaaaaaaaagaaaagaatatacagtatgatttcaaatatatagaagttgttacccttggggaggtagcgagtagaaggaagtatgaagatgaaggtgtctgggattgccagcaatgagcattggttgcatggatatgtttagaatggaaaattctgaatatatgtgaaccttccaaaaaaaagtttttaaagttgtatcagttcattacagtacaaatgtaaaattaggggaattgtttaggagtacccctcttagacccctaattaggagttggaggtctcagtctgtgaccaggattagagttcgttctatggctggaatctgggctcagccaggataaggttctgtgtggatccagtactaatcatcgctgcatcagggctctgcctggcaggagggctcgggagcctttgctctgtgtccacagctcgactgctgccgttccaggatctgaccacttgatgtctccacttcacaaattgccaagtgaggaaagagctggatagagctgcctagacacgtaccggccctgagctgggataggttggaggccatagctcagggaaagacttggaaactgcagagaatgaatccaagtggcagcaaagctggctgggctggggctggggtccaggccccatgcaacaagggcagccatggggaccacagaggcaagtccagctcagaagcccccagctttgcgcctatctcagcagcactggtcggtcattcattcagtgcttcatgagctcccgctctgaggaggaatcaatggaatcaatggaaggaatcactgaggaatcaatggaaggcaaatagggcacagtccctggcttaatggagctcacagtcaggcatacacctcctttctcctttccatcttgtccctgcctagcacgcccagctccctccaacccaaaagaacctccaatattagaatctgccccccaccaactcctcaaccaggatcccatttttcttctttgttgtctgtctccccgactagggcagatgtctaaggagcagggctttcatctgccttgtagaccctggtgatctcagggtcaggcccagatgaccaacaaatattcattgaatgaaacttggatagcagtgaggtgttcacatcatctctacagaaacaaacagaacagagcagggaaacttcctctgggtctgtggcacccagctccccagaccttgcaattctggaggaagcctcagacaaggctttttgtggggtgggtgtgggaacctgagtaggactgagagctggaggtttcagggctgggagggctgcatgacagaaggtgctattagcccagctcatgaacactgagcagttccacttcccccttttcaaagtaagcatggtgggggagggaagagacaggccttgtatcaccccttgataggcccagggacctagctattaaaaacaggaaatatgagccagcagagagtaaggaggaactaactgggggtgccctgtctgcctccaactacagggagcctgccagctaccttaattcagtctaggcagatgacagagaacgaatagaccagcttgactgaagcctcctgagagcctgggaaggagacccaggacatgagtctgggcatgactttggaggagcaggttgtaagaaaggggataaagagctagagctgcaggcagctactccctagaggaaggaggaaggagcagaagcctgagacacagacttggatggccgtgtggatgtgagcagctgtccaggaccttcagaggaccagtttgagcccatttattgggaaccaaaaatgaggatatcaggatggacctccagcaccagggtttacactctgccacccactatgcacggccaatcaacattcccagcactgtccaatagaacagtgcaatgctgaaaatttctatagctaggttttccaatttggtagtcatcggactcatgtagctagtggctaccatattggacatcagagctctagccccatgtgtaaggtgaacaaagagctgccttccaatatttcttttattccctcccactccttccattctttcacaccctcctcttgtgcctcaggctatcagtcaataattatattgtaacgagttgaatttcataggccataagctcatgtaaaatgaatatataaagtaacttatttttgtataactgaatttcatttctatcccaagtgcccatccaacctaatggcagagatttactgtaaataagttcaggttaaatgtggtcaagtgactgcttcctccctctcttcctccagagtgcatctaagtctctagacaggtcagagtgtgtagccagcactcaagcattgggaagaggggcatttggagccttagggcccactgtctatgctaggattaaactatcagtccttgtcctattcatttaatcttcaaacttcatttctgggttcttcgattcttccctttcctgcaggggcagtaggaagagctccagaatcccttcttaaaaacttatagcagcatctaactctactgttccacctgtccacatattcccatactttctatccctttgctaataaaaataaaagcagctaacatttattgaacattttccatgtaccaggaaaattctaagcactttatttatttatttatttatttatttatttatttatttactgagatggagtctcactctgttgcacaggctggagagcagtggcaccatctcagctcactgcaacctccacctcctggcttcaagtgattctcctgcctcagccttccaagtagctgggattataggcacccaccactatgcctggctaatttttcttttcttttttttttcttttttttttggagacagggtctccctctgtcgcccaggctggagtgcggtggtgtgatcttggctcactgcaacctccgccttctgggttcaagcaattctcctgcctcagcctcccaagtagctaggactacaggtgcccgccaccatgtccagctaattttttgtattttttttagcagagacaaggtttcaccctgttgcccaaggtggtcttgaactcccaagctcagacaatctgcctacctcagcctcccaaagtgctgggattacaggcatgcgccaccatgcctggccctaatttttacatttttaatagagacaggggtctcactatgttggccaggctggtctcgaactcctgacatcaagtgatccgcccaccttggcctcccaaagtgctgggattacaggcatgagccaccatgcccagtctattctaaacactttaaaacaactagcccatatagtcttcccaacaactccctgaggtaaatactgttattatccccattttgcagatcagaaactgaggcacagagaggtagtgtgaaaaaagctcacacagatagtattcttattgaggctgtggatgtgttaactagcttgacttaattcttccacattgtattcatacattataacatcactttgtacctcacaaatttatacagctataaattgtcaatttacagtgaaaagagttttgatagattttgctatttaaaaaataactaataaaaaagaaagcattcttgggctaggatctcaaaagccagtattacagatgcatttacttagcaatacaacttccatgagtcaatcccaaaaatactctggcaaatgtctgacacaagcctctttgttacagcactcattgtaataacaaggggctagaaactacccaaacatccatcaacaggggattatgtgaataaattatgatatatttacacagtggaatactatgaagccataaaatggaatgagagctatctttgtatactgtagtagagtgatcttcagaatatattgctaggctgggcatggtggctcatgcctataatcccagcacttcagaagcctgagacaggaggatcacttgaacccaggggttcaaaaccaacctggccaacctagtgaaaccttgtctctgcaaaaaaaaaaaaattgaaggaaaattagccaggcgtggtagtgcacgcctgtggccccagctgttcaaacggttgaggtggccagattgcttgagcccaggggattgaggctgcagtgagccatgttcacaacactgcacacccgtctgcgcaacagggcaagaccctgtctcaataaataaataataaataaaatataaaatgtatatacatatattatatatatatagttaagtaaaagaagaaaagtgtatggctgctagcatttatgtacaaaagaggggaaatcaatatatatatttgcttatattttttaaataaaagaaaagaactttttaaaaaatgactctcgatgagaaaggaagacatcagagtacaaagaacaagtatagaagctagagttacctgaatatacttattttgaagatttggctatggaacgatgtaaatgttccacataatcattaaaacaaaatggaattttaaataaagtaacccctaaaatgaaagcaaaatgaaatgaatgtatcaaactatgtattaaattgatggtataagtgctcagagaagaattatttcaaatgactttaaacatagtaatttgtacattcccatcaggatatacccaaaggacaagaggaactgccaaaaaaattaaagtttttaattttttttttttttttagatggagtttcgctcttgttgcccaggctagagtgcaatggtgcgatctcagttcaccacagcctctgcctcccaggttcaagtgattctcctgcctcagcctcccgagtagctgggattacgggcacgtgccaccatacctggctaattttttttgtatttttagtagagacggggtttttccatgtttgtcaggctggtctcgaactcccaacctcaggtgatccgcccccctcggcctcccaaagtgctgggattacaggcgtgacctgccatacctgaccagtttttaatcttaaaatgttttccataatcatattattaatataaattgttattttatacattataagataaagcaaataaatctaatattattgccactaaaaccaacattttcagcataagaaaaaatataaacataaaagaaataaaaatgctataccctaaattgaaatttaaaatatcagtatgaactcaagatctcttaaaactttttttctctagctctacccactaaaaaggcctagaaacaattaccactgcaataactatgagcacccctagagaaaaggttgcaatatcaaaataccatttcccacaaaagaaccagggctcctaggagaaatagctgattcaaggtctggagcaaaaaatatacaagatgaaccaagaagactttttcattccagaaagcaataaagctatagtgtcatgtcaaaagggctcagaagccaatgtcttgaagaggctcttgttgaccaaagatgaggcaattgaagcatcagtaggatctaaaataaaacagattcaaaatccataagtttataatgatactcaaaaaaagagaagtgatagattggctaattatcctgatttgatcgttacacattgtacacatgtattgaaatatcatactgtaccccataaatatgcacaactattatgtgtcaattacaggcaacttatttgctatattttccttgtttttctgaattttttttctgagctggagtttcattcttgttgcccagcctggagtgcaatggtgcaatcttggctcactgcaatttctgcctcctaggttcaagcaattctcctgcctcggcctcccaagtagctgggattacaggcatgcgccaccacacccagctaaatttttatatttagtacagacagagtttcaccatgttggtcaggctggtctcgaactcctgacctcaggtgatccacctgcctcagcctcccaaagtgctaggattacaggcatgagccactgtgcccagccaatttttttaaataagtaggtatggagccattcttgagtcaagacagtaacagcagtagcaatctttttatgatacttattatcaaattatatactttaagaatgagcagtttatgttatgtaatttctttttcaataaagcacctaagaaagcaagaaagaaaagggagggagggagggaaggaaggaagggagagaaaggaaagaaagcaagaaagaaagaaagagagagaaggaaggaaagaaaggaaaggaaaggaagaaaaagagaggaagaaaaaagaaaaaagaaagaggagggagagagggagggaaaaggaaaacttcactggattccctttgagcatgttaggacaccaactcattattttgaaaataggtaaataaagggaaagaatcaagcaccttttctactttttctgtatgaaccgtatctccttgtaaccaaataattggtgagagaaaatttctccttacagaattatttcagctaagtaatgaggaaaaaatctaaagaatttgaattttgcattttgtactttacacactttaaggaaacaatggatctaggccatgatcgtcaatgcctaggaatcgcacagaatgagacaaatatactcaatgtgcctcctggtataggtacacaatattacctatgaagcattcttgctaaaaacacttaacctgactttattaagatactagtcacatgaactagaagtcagaggaatgtgttagatcagcggtccccaacctttttggcactagggaccatgccgtagaagacaatttttgggctagaagacagtttttccacagacaagggagggagtcaggatgaaacatagaagacgatttttcatagactattttttccacagacaagggaaggggtcaggatgaaattgttctaactcagatcatcaggcattacttagactctcataagaagcatgcaacctagatcactcacatgcgcagttcacaagagttcgcactcctatgagaatcaaatgctgctgctgatcagacaggaagcagagctcaggtggtaattcgagcgatggggagcagctgtaaatacaaatgaagcttcgctcagtggcccaccactcacctcctgctgtgtggcctgttaggaatcaggccgaggaccagtacaaaggattggggactcatgtgttagatgacaccacagggatgcaatccacaaaccagaagatagaagactctacaagataaatgccatatatatatatatatatatatatattttttttttttttttttttttttttttgagacagggtctcactctgtggcctaggctggagtgcagtggtgcaatctccgctcactacaacctccacctcccaggttcaagtgattctcctgcctcagcctcccaagtagctaggactacaggcatgtgccaccacacctggctaattttgttgttgcttttgtttgttgtttgggggggggggtgttggttgtggtggtgtttttatttgtttgtttgttttttggtagcaacgggttttcaccatgttgaccagtctggtcttgaactcctgacctcaagtgatccaccagcctcagcctcctaaaatgctgagattacaagcatgagccaccctgcccagcctcttatttcttcaataaacgaactgaagacagagcaagggaaaatctctccaatcctgcttattccaccttccacacttaaaaaagagagaaagggagagcctaaagggtaaaagagacttaattattaccaatcagtggattgtgtggaccttgtttggatcttgtttcaaataaacacattacatgcaacaattgggtatacacacacacacacacacacatagacatatatatatatatatatatattttttttttttttttgagacagagtgtagttctgttgcccaggctggagtgcagtggcaccatctcggctcactgcaacctctgcctcccgtgtagctgagaccacgggtgcatgccgccatgcccggctaatttctgtatttttagtagagacagggtttcgccatattggccagactggtcttgaacttccgaccttaagtgatcctcccgtctcggcttcccaaagtgctgggattacaggcatgagccaccgtgcctggccaattcagtatatttaaacatggactggatattggattatattaagaattgttgttggttttttttggtgtaataataataattgtggctacatgtttaaagttccttttttagagcgacatggagaaatgtttactgatgaaatgatatgatgtttgagatctgcacagaaattattccataaaggagagagtagatgggcatataattaaagaagtttatctggccgggcgcggtggcttacacctgtaatcccagcactttgggaggccgaggcaggtggatcatgaggtcatgagatcgagaccatcctggctaacatggtgaaaccccgtctctactaaaaatacaaaaaaaaaaaaaattagctgggcatggtgggggggcgcctgtagtcccagctactcaggagactgaggcaggagaatggcatgaacccgggaggcggagtttgcagtgagctgagatcgcaccactgcactccagcctgggcgacagagcaagactccgtctcaaaaaaaaagtttacccataagttgatcactttaagttgggtgatgagtatgtaagggttcattacattattctctttacttttgtaaatgcttaaaatttcccatactaaagaggagaaaaagctaatatttgcttattttcatactttctgcacttctgctataaaaaccacctccaaggccaaaggaaccagagaaatgtgataagataaaaggcattatacaaaaaaagaaatacattggctagtacttcaaactacttagaaacagatgtatagaccaatgaaacagaatagagagaacagaaataaatccctacaactacagccaactcatttttcaacaaaggtgcaaacaacacacatcgggggaaaggacagtgtcatcaatacatggtgccaggaaaattgggtatttatatgcaaaaaaattaaactagacccctacctttcaccatatacaaaaatcaactcaaaatggattaaacacttagatctaagatccaaaactatgaaactctactagaagaaaacatggggacacattttttgacattgttttggacaagggttttttagataagccctcaaaagcacaggcataggctgggtgcagtggctcatgcctgtaatcccagaactttgggaggccaaggtgggcggatcacgtgaggtccggagttcgagaccagcctggccaacatggcgaaaacctgtctttgctaaaaatacaaaaactagctggtggtagtgacatacacttgtagtcccagctactctcagaaggttgaggcaggaaaatcgctcgaactcggaaggtggcggttgcagtgagctgagagcacaccactgcactccagcctggacgacagaacaagactctgtctcaaaaataaagtacaggcatcaaaagcaaacatagacaaatggaattacatcaaactgaaaagcttctgcacaaaaaaacaacgcatgaagagataacacacagagtgggagaaaatatttgcaaactatacatctggttaatatccagaatatataagtaactcagacaactcaatagcaataaacaaaaacaaaaacaaaaaacaaaccaaatagtccaattttaaagtggaaaaaagacctgaatagacatttctcaaaataagagttacaaatggccaacagatatttgaaagaatgctcaacatcactagtcatcagggaaatgcaaatcaaatccataaacagatatcatctcactccagttagaaccattattatcaaaaagacaaaagacgagtgttggcgaggatgcagacaaaagggaacccttacacgctgttggtggaactgtaaattagtacagctgttgtagaaaacagtatggaggttccccccaaaattaaaaatggaactaccatatgatccaggaatccaactactaggtatacatctaaaagaaataggctgggcccagtggctcatgcctgtaatcccagcactttgggaggccgtgacaggtggatcttgaggccaggagtttgagaccagcctggccaacatggtaaaaccttgtctctactacaaatacaaaagattagctgggtgtggtggcacgtgcctgtagtcccagctatttggaaggccgagacaggagaatcacttgaacctgggaggcagaggttgcagtgagccgagatggcaccactgcactccagcctggacaacagagtgagaccctgtcttgaaaataaaataaaataaaggaaaggaaaggaaaggaaatcagcatgtcaaagaggtatctgtgctcccatatttattacagcattattcacaatagccagtgtatggaatcaacttaagtgttcatcaatgaacgaatggatgaagacaatgaagtacatgtaaacaatggaatactattcagccataaaaaaggactaaatcctgttcatttgtgactacatggatgaatctggtgactttatgttatgtgaaataagccagacacagaaaaacaaactgtatgttcttatctgtggaacctaaaaaaatcgatctccacttggcacagtggctcaagcctgtaatcccaacactttgggaggccaagaaaggaggattgcttgaatccaggagttcaagaccagcgtgagcaacatacgaagactccatctctacaaaaaatttaaaaatttttctgggtaggcgcagtggctcatgcctgtaattccagcactttgggaggctgaggtgggcggatcacaaggtcaggagttcgagaccagcctgaccaatatggtgaaaccccatctctactataaatacaaaaaaaattagccgggcatggtggcaggcacctgtaatcccagctacttgggaggctgaggcaggagagttgcttgaacccgggaggcggaggttgcagtaagccaagatcgcgccactgcactccagcctgggcaacagagcaagactctgactcaaaaaaaaaaaaaattctgggtggggtggtacattcctgtggttctcagctactcaggaggctgaggcaggaggatcacttgagcccagaagttcaaggctgcagtgagctgtaattgcaccactgcactccagcctgggtgacaaagaccctgtctcaaaacaaaaaaagaatttttgttttaaatctcatagaagcagagagtaaaatagtggttactagaggctagggagggattggtagagggaggaggaggagaggttggccaataagtaccacgttacaattaggtaggagaaataagttctggtgttctattgcacaatagggtgactatagttaagaataatgtacatctcaaaatagcagaaaagaggatttgaaatcttctcgccacaaagaaacgataaatgtttgaggtgatggattttttaattaccttgatttgattatcatagtgtatatacgtattgaaacatcacattgtaccccataaatacaatcattatgtgtcaattaaaaataaaataattacaggtgtgagccaccatgcccagcctgaagtgccctattgaacatatgagtctagagctcagactatctccctctcagataccaaacaacccttatttatttcacactggtcttctctttattttattttatttatttatttttttttttgagacggagtcttgctctgttgcccaggctggagttcagtggcatgatctcggctcactgtaagctctgcctcccgggttcacaccattctcctgcctcagcctcccgagtagctgggactacaggcgcccgccaccacgcccagctaattttttgtatttttagttgagacgggttttcaccatgttagccaggatggtctcaatctcctgacctcatgatctgcctgcctcagcctcccaaagtgctaggattacaggcgtgagccaccatgcctggccccacactggccttctttcttttcctgaacaggccaagtttcctccagcctcaggaccatggcattgctattcctgttgcctggcatatttctcccctagatggccacatgactagctcttaaacattcagatctcaggtcaaatatcatctaatgagaaaatccttgctcggtcgggcatggtggctcacgcccgtaatcccagcactttgggaggctgaggcgggcggatcacctgagcccaggagttctagaccagcctggcaaacatggtgaaaccccatctctactaaaaatacaaaaattagccaggtgtggtggcaggcccctgtgatcccagctactcgggaggctgaggcagaagaattgcttgaaccagggaggcggaggttgcagtgagccgagatcgcaccattgcattccagcctgggtgacagagtgagacactgtatcgaaaaaaataataataataaaaaagaaaaaaaaagaaaatcctcgctcaagacccaagctaaaatcaatataaggagtgagccagggatccacattggtcagattttgctgtgacaatgatgcataaaagacaacttccagaagcctggtgcttacagcagtaaacattcacttcttgcccaggggtctgtgggtcaagctggggctctgcagggctttctggggctagctgggctgggctccaggctttggggtgagtaggtggctgtctcatatatcttctcatttggagtccaggctgaaggagcctccactgtctgggacttgtggttctcatggccgaggacagttgctcaaagggatgaatggaaacactttgtgccttgggcctggcccctgtgacttccacacatattctcatggccaaagcaagtcacgtggccaagtgcaatatcaacagggtgaggaagtatattccttccgtggtggtgggggctggggaaagtaaatatttgctgaacagtaatacaatctaccaaatcacccaattctttttttcccccagatggctatgtttattgagtcatccctccacattcttatgaaataccatcttttacaaacgaatgaatgaatgagaaatgtgcctttcaaggcaggaggagcctccccatgcttcaaatgagaaacctgaggctcagagaagggagtgagtcacccaaggtcctagaaaccacctgtggcaagcccagcctgtcgggctcctcagttcacttctctacatacaataaatgaggcaggaaagtgcaattttctgggcagtgaggacacatcacccgtcctgccctcccactgaggcttgttgacaggcccataatcaggaggcaagtataccaaaaggtttccttgctgattcaatctcggggctcactctgaaaccaagtaggaccttgatttgtcatttccgggtctccgaaccacaaatgttaagtacgtattaaatgagtgagtcactggtcctgtggacattttaattgctgattaagtgttccatgaattctgggtcccgccccaactgtgcctgcccctaaggtacagacagtcacctctacttcttcggggacctgcagtgtctaacaccgactagggtacacagtgacactcaaaaatgaggcataggcatataggccgggcattgtggctcacgcctataatcccagcactttgggaggtcgaggcgggcagatcacttaagcccaagagttcaagatcaccgtgggcaacatggcaaaactctgcctctacaaagaaaaaaaaaagtcaggtgtggtggtgtgcacctgtggtcccagctacttgggaggctgaggtgctaggattgcttgagcccagaaggcagaggttgcagtgatccaggatcacatgccactacactccagcctgggtgacagagtgagaccctgtctcaaaaaaaaaaaaacaaaaaaaaggtatagggcttaggcaaattctggaaggacatgcctcagataaacagtgggcaacccttttgaagcaagtttacttagaactttaactctctgctttcggtctttatgtagcatttgaacactccacaatcagtatagattgcttctataggcgtgagtataggtatgcttctgattgcacaggtagcattcagagaaccaatctgaaactggtctaagtccatactagtgtgcaaaaagcaattacttgctgattggttgggaaactcctgaaaatcatcttcctccagaatccttctcccacacattatcagaagcctgctttcagaaacactgagtcaattctcaaccactccttcagtcagtaagcccgggagcacctacagcacgccaagtgatgagtgagccaccagggtgacaggtgataggcagggaaacaggtggtagccagagtcagtggggcctgcattcaaaccattgctgacatagatggcactggaccatgggccagacactgtgctaaacgccccacaaggattatcacgtttaatccacacgacaagttgatgaggcaggcactattattatcctgtttgacagctgtggaaactgaagtgcagagaggcaaaggaacttgcccaaggtcacataactagcagatggtggaaccgacatttgattccagagtctgtgatccccactgtgacccaaaactgcttcccactaggaacttgtccagattccacaggcagtaagtgacagtcaaaattcaaactcagaaaggttcatcagcctccaaagaatattgtcttaactgataagacgtcctcccttccaactccctccatttctggatccaacaccaacatgctgggtgaccttggggagcctccctgacctcagttttcatggctgcaaaatggaaagaacactgcttaccttaaggagctgcagaggggcttttatgcgaagacagttcctcctgtagaaatatggtaggcactcagttgagatacatctgtgttctttctggtttccaggagtttggggcagttggacaagtgggcactggagcaagtctgtgtgataagctctatgactgagagtggactaagtgctgggccagaggctgcacatgggatggaaagccaagggctgctgtgtacccagaaaactcaactgaaggaacactggaataaacaaccctcagaaggagggaagctttgttcgtcatctttcctgttttcctagtctggcccagttccaaaacctcttcttaatcgtgtcaggagtttggcccagtgccccaggaaggagccgccaggaggcttatagtgagccaagtcttcaaggaagtgatgtcttctgtaagtcaagagaaggcaagaaactttctgggagagagaaggagatagggacagaaacagggaagcgctcagctggaagacccttccttgaagaagtggagaaactgaggcttagaacagagcaaggtttactgattgtgctggtggcacggttggggcaagtagcttgtcttccttcctcccaggtcagagtcctctccactgcatgtattgactgttcacccccttcctattctaggactacccaggcagggggagctgccttcactcaccctttcccactactgcttccagaaacatctccccatcactacactagggactttgtaagcacagatgtgggacccatgagtactacagaaggaagcagaagctgcaaagaccttggtaagttcggccatgcgggaaacgaggatgacagaccctctgaaagaaagaaccagtgcttcccaacacctactgtgtgtctgtgcaatgccaggcacatccaacatgtcattatgggatccttgggctgtcacttcaccagccagaaacctctgtagccagtggtgcctttgccagagttttgctcaggctcattgcgcccacttggcctggcaggctatgctcagctcgtgctaatggcctggatcccctgcctgccaagggcgagcggagcagcgaggatatgtgtgagcaagcaagcgtggggtccagccactgtgcacagccaggaacaatggctgtggtggagtgggcagctccaggtgccagcatgagtgctggcttcttacgaggctgcagctggaacaggcatcctgcaagcagcttccactgctgccactggggaatgcaatggttcctgggggcttggatatgtcaggaaccagacccccaaagagggtgtcacagccctggctcagggagctcctaggtctggggtccccgaagggcctcagctcttctccccttcttcttacccacaacgtggtgagcaagaggtgtgtttcagccgtgtttgtgttacagcgctttcagccctgccattcaggaggtcctgagttcttgtcccatgcccgggaagaatgaggtacacagacaagtggagggtgagcaagctgaagagctttactgagcaatagagcagctcagaggagactcacagtgggtagctcctctctgctgccagggtgtcccattaatgttcaactttaatgttcagctctcagcagagaggagctacaagaccctggaatgggtagcttctctccgcagctggtcatcctgatgtctgctgagctcccagcagagaggagacttcagaggggatagctcctttctgcagctggttgtcccaacatctctctgagtctggctgagtccaggttcttatgggcttcagaggggaggaagtgtgtgctgattggtccatggttggccatgggcaggcccagaaaaggcaccataagttcctactccaatctgcaggactggcagcctggcccccaggcttcaggccttcccaggattgaaggtggggcttcaccagggacccacccctttttgtccagagcctatctgcctcctgccactgttcatagcacccaggctgttcaggcagaggggcacctgcaggccagtgctgagctgccctcagcccttccttggtctcccttccatgttagtttgtgcccaaagtctgaagtgggccaaggtggcagggggctggtgtgtcagtgctgccccaagcatgcacacacccagctgggttgcgacagtgcctgggatcagcctcaactttgctctgaaatcgaagcaggtgccaggagcagggaaaggccaggcagtggaagcaggcatttctgagcctgcaggggcaggggggccttcctgggcccccaagagtgcagagatgcctgggtctgcagccctggcttgggcagctgcagctgcgcccaaggagcatgaagcttccaccctgtcaactcagaagacggcagggcttctgcctgttcccggctcctgctggttctgtggagcacctcccccactgcagcctgcatcatggcagtggccactctagacaggccaccactgccatcaatgttacataatctaatcatcacactaactctgggaagtagattacatccccattttgcagataaggaacctaaggctcataggggagacatttcctgcccaactctatctccagcccataactgtcttccaacctctaaacctggctatctactttgtctcagatattcctacttataaccccacatgcttctcaaagtcaccttgaactcatcctcttcccctcccatagatttctggtctcccatcatagccttactactcagaaccccagatactaatgttgactccaccctctcccctatttctatctccaaatagcctgggattagtggtccccattccaagtctatttcctagacattggccttcaattcaaagggatgtagcatagtccagacttttatcatctccctcttagataacttcaacagtttctgtaaaagctcctctgcctccagtttatccttccatccatccataccccactcaaaatgtcaggggcaatctttctaaaatgcaaatctgtctagtctcaaccagctgaaaactctgccatggcttcacagtgccctcaggataaaccctttacagaggcttgcctggccctaaaagtcttggcccttgctgccttctctggggtcaggttgggtcactgtctaccctctgcccctgaagccttggacgtcctggaatacatacagttcctctttcacttcaaggctttgacccctgctgttttctctgccttcctccagctaactccttctcatctttcaggtctcagcttagtcaccacttcctgaccaccctgctcttaggcttcctgagctgcccttccagtgaatcccgcagttcccttatacttcctacactgggttacccaccccctccttctcacattcccctgtacagcccaaaacagccttccccagcagcacagaacactggggcagcactctccaatgaaaatacaatgcatgccacgtgcataattataaatttttgggttgggtgcggtggctcatgcctgtaatcccagcactttgagagtccgagatgggtggctcaagtgatcatggtaaaatcctgtttctttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagctgggatggtctcaatctcctgacctcgtgatccgcccgcctcggcctcccaaagtgctgggattacaggcgtgagccaccgcgcccggccgtaaaatcctgtttctacaaaaatacaaatattagccaggcatggtggcatgcatttgtagtcccagctactcaggaggctgaggtgggaagattgctcgagcctgccgtgagccatgaccatgccactgcactccagcctgggtgacaggctgagaccctgtgtctaaaaaaaaataaataaaataaatcaattttctagtagcctctgtctcccaggctcaagtgattctcccacctcagcttccaagtagctgggaccacaggtgcacatcaccacacccagctaattttttgtagttttgatatagatagcatttcgtcatgttgcccaagctagtctcaaacacctgagctcaggggatccacctgcctcagcctccccaaatgctgagattacaggtgtgagccattgtgcctggtctctagtagccacattttaaaaagtaacagtaaatagatgaaattaattttaataacaaattttaacccaatatttcaacatatatcaatataaaaagtatgcatatttcattttatttttgtactaagaatctgaaatccagtgtatatttcacactcacagcacatctgagtttgaactagccacatttcaagtgctcagtagtcctgggtgctagcggctatcagattagacagtgtagttttagaggatgcttacagctaactggcctatgtcctgtactggaggacattcattctgagaaaaattcatagaaattttcctctttggaaaaaaggattctaagtcagaccggtcactgacagagtgaaacagggtttttaattctttaggacctcaagagtcttctctgtgctagtgtgagatgtgatacagaccagagaacatgtaacatctccccagcttacttgagctcagagctctgttttcataaagatttctggggaatgagatgtgataaagaccagaagagcgatatagcatttccccaacttatctgagctcagggttctgttttcataaggcctttcgggggattagtgtccagtggaatgttctttggcaaatgttgatacagccacatgcctgactcagtagatcccaggatccccacaggaagaatgtagagttgaggaagtctgcctcaagtgcctcagcacctgagactcgattactgaattgactaaactaattatgggaggccatatagggcaggactagaattagtgagcaaaaattgcagcatatttcagctcaaacaaggatttttttttattgtgtgtgtatgtgtgcgcacacatgcgtgtttttaaaaatttaaatctaagttgccagatctgtctaaaaaatgcaatatgtggccttgtgagatgatgatttctctgtcactcataatcaaggagtgatgaaggctagagttctttgtggggtagggggctcctaaccagagtctctaatttttttttccagaacttaaaaaaggtaagaaaaaaagcaacaatgggcagagaacttgagcatcagaggaactgatcagacatgctctggaccatttattaagagcacactttgggattctggagccttcagtggaagattggtttatagccaaatcccttttgaggctacagattcttggttcagttcagatgattttttttttttagacagtctcactctgttgcccaggctggagtgcagtggccaccatctcagctcattgcaacctctgccacccaggttgagtgattctcctgcctcagccactctagtagctaggattacaggcatgtgccaccatacctggctaactcttttgtatttttagtagacatggggtctcaccatgttggccaggctggtctcaaactcccatatctgcccacctcagcctcccaaagtgttggattacaggcatgagccactgcacctggcctatatcacactttgataaaaggttttaaggctgggtatgggctgggattacacctgtaatcccagcactttgggaggctgaggtgagcagatcacaaggtcaagagattgagaccatcctggccaacatggtgaaaccctgtctctactaaaaatacaaaaattagccaggcatggtggcacacgcctgtagtcccagctactcaggagactgaggcaggagaatcgcttgaaccagagaggcagaggttgcagtgaaccaagatcgtgccactacactccagcctggcaacaaagctagactccttctcaaaaataataataataataaaaaaagggttagccatgctaccgagaggcccctaaccacccacagacagacagacagactgcagatggaatcagaccaatcatctcagagcctccaggtgcccatcagtaagatgcctggaaggacctggaagctgaggcctttaaaggttgggctcagtgtctctatgtcaagcacggggcctggtacaatgtaggtgttcaaatagttgtctccttccttcctcatacctggattttaggtgtggcagttccagaaatgccatggcctgcgtaagaagggtctggagtgcctcatttaaagctcacaaggatcacagaggctggcacagctgggctgagaacagaaggggaaacgaaaccctttcatggctcacatatgctcaagcaactacaaagaagccacctgtggtcagctgaagagtggatgggggagaaagagggagcttcagagaagtgggggtggtggtgaggaagaaggtttttaggtggtagaagtggaggaggtcaaagaaaacagcagttaagaatcataggcaatacaccatagggtgagggtaggggtggggaaggtaggttttgggtggtggagatgggaaaggttaaaaaaaaaccacagtggttaataataggcaacacaccatccatcgtgcggaggaagaaaccctggacttagaattatgtgattttggcaaaacatgtaaccaagcagctctctcatctgtaaaaatgggacaataatagttcctttctcttggggttattgagaggttgaaatcagttgatgcatgaaaaatgtacaaatcttgctgttgctgttaataataacagtattgataataccgtaggaagaagcttctgcttctgaaaggagaccaggtggactgatttgggaaccaaaaacaaccagaaatctagagggaaggggagaaggcaaggagagatcttgatctaggtgcaccagaacttatatgcaaaatgctgtttttaagtgcataggtattaatatttattagaggaagagataccatagcccacatcagcttctcaaaggagtctatctcacacacacacacacacacacacacacacacacacagacacacacacacaatagtttaaaaatgactgatctagagaaattaagagccaagagaaagaagcagatgagacaagaggcccacaatcatccatggttggaatgagccatctccatggacctaagacttgggatcaggggtggcggaaagtataaacagaagaggcaaaaaaaagagtttgttggaatgaagacttaaagaaccaagtcagctcacagtgggaatggaatgggggttagttcagctatcacatggcccagagcaggctcacagaggctgttggctgaaggctgggtgagtggatggatgggcagggagcccgacccagcagctgaggattggggaaactagggaggcagactgcagatcaggaggcaaggcataagagagaccttgactctagaagactggcagggattgactggagaaatgatttccgtttgcctggtgtgatgggaaagaactgtcagccagtgtatacttctccccatctaaaatacttctgattctgtgggtgaggatttgcaagaaggcactctgccagggggagggacttaactgttggctctgtggctgtttcaggaacactctagggcagaggggggtggggtgggcagagacttttctttttgaaatttgtgagtttgtaccctgacttgcccatttcattcatgtattcatgcaacaaatatttcttaagcacctattatgtgcccacctttctgccaggtgttggagatgcaacaataaataaaagatagaatagtccctgaacttaaaaatcttacatctagctgggtgccatggctcacgcctgtaatcccagcactttgggaggccaaggcgggcagatcatgaggtcaggagatcgagaccatcctggctaacacgctgaaaccccatctctactaaaaaataaaaaaaatattaaaaaaattagccaggcgtggtggtgggtgcctgtggtcccagctactcaggaggctgaggcaggagaatggcatgaacccaggaggcggagcttgcagtgagccgagatcgcaccactgcactccagcctgggcgacagagcaagactccatctcaaaaataaaataaaataaaataaaatcttacatctagttgaggaaatggataatgagagtgcagtatgataggtgctgagactggggccatgcgcaagttgctataggaacagaggaaaagggcactcatacttccccaagcctgtcttctttttatttatttatttatttatttatttatttatcatttgagacagagttttgctctttagcctaggctggagtgaatggtgtgatctgggctcactgcaacctccacctcccaggttcaagccattctcctgcctcagcctcccaaatagctgggattacaggtgtgaaccaccacgtccagctaatttttatatttttaatagagacgaggtgtcgccatgttggccaggctggtctcaaactcctgatctcaggtgatccacccgccttggcctcctaaagtgctaggattataggcgtgagctaccacactcagccttaagcctcaatcttcttatctgcaaagtgggaatcatggccgggtgcggtggctcacacctgtaatcccagcactttgggaggccgaggagtgtggatcacctgaggtcaggagttccagaacagcctggccaacatggagaaatcccatctctactaaaaacacaaaaaaattagctgggcgtgttggctcgcacctgtgatctcagctgctcgggaggctggggcaggagaatcacttgaacccaggaagcagaggtcacagtgagccaagattgtgccattgcactccagcctgggcaacaagaacgaaactccatctcaaaaaaaaaaaaatgggaaccatgttattcactataaggagttttctggtacattccaggcctctgcttgacacatattaggagcccgttgcagcccataattcatttattcaacaaatgttaattgagtatcttatgtgtgtcaggcacttctgtggatggtagaaatgtggcactaaataaactgagaaagccgggcacggtggctcatgcctgtaatcctagcactttgggatatcaaagcagaacacctttaagctcaggagttcgagaccaatctgggcgacataggaagactctgtgtctacaaaatataaacaattagctgagcatgttggtgcacacctgtagccccagctgctcagcaggctgaagtgggaagattgtttgagtctaggaggtcaaggctgcagtgagtcatggttgtactgctgtactccagcctgggtgacaaaataatattatttttgtctcaaaaataataaataaataaataaactgataagaattgctgctgtcatcaagattacatactacacggggaaaacaataagtaaaatattccgtaggccaaatggtgacaagtgcattggagacaaataaagcagggatggaaagagggaagaactgagggaagggggttgtaattttaaatagagtagtcagggcctgtcttagtttagcaaggatctgaaagaagagaggcactaggccatggagatatctggaggaaggacgttcgaggtagaaagatccacaaatgaaagggctaatgctggagaatgagtggtgtgtgataggcttttacagagcccagagtggctggaaagaggtgaccaaggtgtacagcaccagcagatgaggtcaagggaggccttggaggggagcaggtgtggcagagccttggggccattgtaagtctttgactttaccctgaatgagatgggagccactggagagttttgcgcagaagagtgacaggatcttacgttttgttttgttttgttttgttttgttttgttttgttttgttttgtttcaggaaagagtctcactctattgaccaggctggagtgcaatggtgcaatcttgactcactgcaacctctgcctcctgagtttaagcaattctcctccctcagcctcccaagtagctgagattacagacatgtgccaccatgcctggctaattttgtatttttagtagagacggggtttcaccatgttggtcaggctggtctcgaactcctgacctcaggtgatccacccgcctcagcctcccaaagtgctgggattacaggcatgagccaccgcacccgaccttcttctttctttctttcttttttttttttttcttgagatggagtctcactctgtggcccaggctggagtgcagtggtgcaatctctgctcactgcagcctcagcctcctaggtttaagcaattcaccctgcctcagcctcccaaatagctgggactacaggcgcccgccaccacgcctggctaaattttttgtgtatttagtggagatggggtttcaccatgttggccaggctggtctcgaattcctgacctcaggtgacctgcccacctcagcctcccaaagtgctgggattacaggtgtgagccactgtgcccagccctttttcttttcttttcttttcttttctttttttttaactgacaaggtctcctctgtcacccaggctggagtgcagtggtatgatcatagctcactgcagcctcaaactactgggcttgagatccttctgcctcagcctcctgaataactgggactagaagcatgtgccaccaggcccagctaaatttttaaaaatgttcgttgaaatagtatctcactgttgcccaggatgatcttgaactcctggctctaagtcatcctcctaccttggcctctgaacgtgctgagattacaggcgtgagccaccatgcctggccaggatctcaagtcttaaataggaccactctgttttaaaggatcacttgttctgactatataccatgagatgacaaacatagagcagaggacaccagttaggagactcccacattaaaccaggtggagatgatggcaatttgggctaaagtgaaagcaaagggcatggtgagaaatggttaacatcaggatatttgaaggtgaagtcaacaggatttgttgacaaattggataagggggagtaggcaggcaaaacagagtcaaggatgcggggcgtggtggctcacgcctgtaatcccagcaccttgggaggctgaggtgggcagatcgacaggtcaggagttcgagacaagcctgaccaatatggtgaaaccctgtctctactaaaaatacaaaaattagctgggcatggtggtgtgcaactgtagtcccagctactcaggaggctgagacagaagaattgcttgaacctgggaggcggaggttgcagtgagccgagatgttgccactgcgctccagcctgggcaacagagtgagactctgtctcaaaaaaaaaaaaaaaatagtcaaggatgacctgagccattaactatgattggggaagaccaaaggaggaacaggcttgagaggaaagatagagggttgatttgggacacattatgtttaagaagcctgttggaagtccaaataggaatattaggtaggcagctggatacataagtttgacacctgggggcaaggccctgattttaggtatgaacttagaacttctcagtatatagttggtatttaaagccacaggagtgaataagatagtgaatcaagaggacaaaggaaaaaggtctgaggattgagcccaggggctatccaacatccagcagtgggggcctcacctgcttttaatttgggggttcgaaggctaggtttgaacattctgtaaggacttgtgcaaatattttccctaagttctgtctccccctttgaacccaaatgctcaccatgaagggaaaagtccacagaagaaaaaaaaaaagttttaaatagattgtttaaattattaggttatgttttccaaaaatagaaggaaagctaagttctgggtcagtgggagaatttagagtttttagcattatctttctcccatcaaacccttaaggctgggctcccaaggaagagtcttcctggctttccagccctgagggctctctcacaaggtcccagaactctgtattgtaattgtctattttctctacctccaggtggaagccatgttgagttcatcacagaactactagccgggcctggcaccaaataggcatcagggaatgtcagtggaacttgactgcagaatctgatgaggaacttccatcttcctgggctctgagtgtctttctctagttccaccaccagagctggtgtctgttctgccaggcccctttccaggcacccatagctgatcctggaaaggtagggacagaccctgtaggcctggactctgtcctttgggaggagaatatcctcaggggcctgcatgagccatcctgaaaaactagttctgtgagtcaatcctcaagtgagttcctgtgggaaaggtaccagaatcttagaggtgaggttggaagcagcttgtcacctcttagaggcaaagaggggtgtctcctccgaacggacctcactctttatctgacccagagttcctggcatatcaactgtgctagtactttgtcaagggtgctggcatgagccaaaaggccctgaactggaaattgcagaccctcctattagacatgagtgtgtcatgtccatcataaacaaagaaacaaaaaccctctcttaacgcaggctactttagttgctgcattatattctgcctactgtttgtagctaaatctcttgaatgacttgttcaaacttgctatctccacttcctcaccttctatttcattcttaactcaggtccattcctaaaataaggctgtccttccaggccctcccaaatgatgtcatctagtgtaattaactccaggtactaccatgatactaataacctgcagtccctctcctgagctccaaactcacgtattcagctgcctattagacatcttgactcagctaacccacagacacttcaaactcaacatgtacagaatgaactcatcatctttccttaaaacagatcccaagtgttccctgtctttgtgaatgcactgccatcctcatccttgactcccccactccctttcctttgtatatataatcagtcactaatacatcaaccctatgtcatgaatatccccgaaacacatacacttctctccatcctcatggcttttttgctgatcagggccatcatcatcatttttgcctcaatgatgacaataacctcttaactgtattctaacaagctttgtgtagtgttttgttctgttttagagacacggtctcactctgtcactccgtagagtgcagtggcatgattacagctcactgtaacttcaaactcctgggctcaggtaatccccgcacttcagtctcctgcctagctagggactacatgtgcatactcccatgcctgactaatttgaaaaacatttttgcggggagagatgaggtcttgctatcttgccttgtctggtcttgaactcctgggctcaagcaatccttccaccttggtctcccaaagcattgagattacaggtgtgagccaccatgcccagccaagcctcaagtcttgaatactttaaatccattttctttcttttttttttttttttgacagcgtcttgctctgttgcccaggctggagtgcaatggtgcaatctcagctcactgcaacctctgcctcccaggtttaagcaattataggtgtgtgccaccacacccagctaatttatgtgtgtgtgtgtgtgtgtgtgtgtgtgtgtgtgtgtgtatttttagtagagacgggatttcgccaagttgcccaggctggtttcacactcctgagctcaggcaatctgcccacctcagcctcccaaggtgctaggattacaggcatgagccaccatgcctggcctgtaggtaatattttctaaaacacatattatgttcctccattgctcatagcaactctcagtgacttcccagtgctatgaagataaactgcaaatgccttagagaccctgcatgaactgggccttgcttacctctccagcttcatctctcactactcctcttcaccctctaccccttagccatactgaattaccagcagttccccacataaaccctgctctttccagtttccaaatttttgcccatctgttctcttggccttgagtgcttgtctccctcacttgccttctttattctccccaacctttacctggctgacttctgtttccattttgagacctaagtttaagtgccatttccactggaaatccgtgcctgactctgtaattctggatggcagttcttctaaagggctcctaccgcaaacacactgtactttatcctcgaggcactcatcacagtaagtgacaattacttgttcccttctctgtctcacccaccagacctgagctccttgagagcaggggccttgtctttctagttcacggctgaattcctaatactagcttagtacctggcttatagttgattgtgtgtgtgtgtgtgtgtgtgtgtgtgtgtgtgtgtgtgtgtgtgatgcagggaagccaaagaagggtcaggatgcaatgataacctggggaaggagggacaattacaaaggaaagtcttgggcagattccatacaggtagtagccaccaatgggatgtggaggacaggatcaagggttaactcaagaggcttcaaggttctgagcctgagtgactgggaggaatagagctattcactaagcagagaccatagaagcgaagggcagtttcaggagaaaagctgaacccaggaccaaagggctgtgggggtcatcaagtggacacatgaaataggcatatgggtaaatatttctatggttctaaaaaggagtcaaggctggagacattcatttaagaagctacctggccaggcacggtggctcacgcctgtaatctcagcactttgggaagccaaggtgggcagatcatttgaggtcaggagtttgagaccagcctggccaacatggtaaaatctcgtctctactaaaaatataaaaattagccaggtgtggtggtgggcacctgtaatcccagctactcgggaggctgaggcaggagaattacttgaacctgggaggtgaggttgcagtgagctgagatcacaccactgcactccagcctgggcaacagagtgagactccgtctcaagataaaaacaaggctaccaagatgggggcatatagagagaagacaagtgtgatgatataatcttggggatccattaaattgtgctgaaagaagagagggagagagaaatggtatttggacaggtaagaaaaaagccaggagaattaatggtcattggatccaaatgcaaaggacctcaaagaatgtgctcatccacctcattgagtgttgcaggaaggtggagaagaataggctactctacttggaaactaggaagtccctgattagaatagaagccagaccaacagtgttaaaggaatgaaaaataaagcagaaaaggcagcacatgtagactgtcctttctgaatctttcaaacacaggtgagggcaacagtgacctaaggacaacttgggaagcaggttaggggttctaagactgggctccatacacacactgcttaagttcaaatcatagccccaacactcaatagctgtgtgactttgggcaagttaacttacttaactttcctaagtctcagtttccttgtctaaaacggtgggacaagtagcccctgtttcatatggttattgcaatgattatatgaaaatgtatgtgaagcactcagcacagggcagagacgtggtaagcaaccaattaacgtgagacatgaattttaacagggtcaaggaggaaaactgggaggaggagaagttgccatgcaggagggagagaagatgctcgggtgaactaggctttgaggaggtggaagggaggggactgaggacttggagggcttgtggagagggaggatggggaagtaggccttttcaaaacccaactttggctaaaggatcacctgctggttactgaatgaagcagctacttctgttccattttcttggggagtcatgctgaggcatctctaggagcttctctcactcctagaatcttccagtgtttcctggagcctggtctctgcctctatgcctcccactgcctgctggttctctagctggaggcagctggactcaggcagccgcaggatgtcccagcagcacacattgggagagggggattcagagagagctgcttcacaacttctctttgggctatacccttgacacaggccaaatccttctgtccccgtcacaggtacagatactttctatcttcaggtattccaaatgatcttccatgattaaggttgcttctgaaacacaatggtctccctggacctccgagctaatctgcctatttccagtgtcagttccaccaaactgttccccctctgctgcctgtgattgttctcatacctgtttaaaaccctgtcataattcaccttgcagtatctccaccagaactgggagggcctctcccacctgcccagcctacattggttatatcttcacttttaccctctgctccatcctgaccaaagctatggctctgcatatattgcctctcttcttgcaatatcttttcttctcttccacgggctagcaacccctcatctttcaagaatagtgtccaactagaaacctttcctaatattgcccccaccaccactggtgagttggatgtgctcctttactcaagagttcccacagcaactggtggctggcctcctcttccctattattccttataccttagtgttacagctggagaatacctctgtctcattatcagactaggcactcttccaaaatgaggattaggtcttataaatagctgtatctctagggcttagtataggacctaccaacctcaaataggtaagtagtacctatttgccttcattcctcagggaatactggttgaatgaataaatgtcctcatttaggatgtattctggcaggaagacaatggagatgcaagtggactacttttcttgccccaagccacatggccaggatcctacatctttgttgcttgactgcctctcatttcataattcaagagttgccagctttcttattgatactgaccttttttttttttttttttgagatggagtttccctctcgttgcccaggctggagtgcaatggcgcaatctcggctcactgcaacctccacctcccaggttcaagcaattctcctgcctcagcctccctagtagctgggattacaggcgtgcagcaccacgcctggctaattttgtggttttagtagagaggggtttctccatgttggtcaggctggtctcgaactcccgacctcaggtgatcctcccgccttggcctcccaaagtgctgggattacaggcgtgagccactgcgcccggcctgattctgacctttttattccacacatctcaactgttgctgagctgtttcattctaggaggcaaagagcttttctggttgttcctgagatcaccagcctgaatctcctttcttgagcacccagcagtttcttttccaagggtatcggaatcttgaaagggcagcagattcttaggcatgggcggggagagctgctagaagacatcactgtcaaagaattggcaaagtcaagaatgtgccagcatccaagggtcaaaacgtcaggtgggacatcctgttccacagcatgatagccccagagggggtgccaaaaggatgacaaaagccttgtgagtgcccaggaatcaagtagagattaggaccaacccatcagagtgcaattaagcaaaagggggaatcaatttaaaggtgccagaacaggaaccatgcaaccaggcttcaggagaaagtaggaacgagggtcctgaacttcattcatcagggtcctctctctctcttttttaagacaaggtgacactctgtcacccaggctggagtgcagtggcacgatcttggctcattgctgcctcagcctctcaggtgttcctcacctcagcctccctagtagctgagactgcaggcacacaccactatgcccagctaatttttgtttgtagagacagcattttgccatgttgcataggctgacttcaaactcctaggctcaaatgatccagccgcctcaggctcccaaagtgttaggcttacaggtgtgagccatctggcgggagggacttctatctcttatctcttctcttcctccacccactttctcctatatcctcccccacttccaggtttctctggcccttccaacagcaagtatcgccaggagcagctccctaatctacatactacagatctatccacaagaagacagatggaaccactcttttcttctgaattctagaaccttaaggaagttaacctgagtggctcagcttggatcaagtgcccatcctggtccaaacaactgtagcagcacatctgtgtatttgtgtatcttgttcctccataatcttgcagtccggggaaagtgtgcagatggatgggtccctgaaaagcaagagttgtttagacaacgctagaggtgttcagttctgggagacaagagttgggccaggttgataactagcctaagagagtcggaatcagatgaataagaactagatcttgggtgacaacctagatcaagagtcttgaggttcagtcatttcaaaaagctcaagtctcattgcttcttggccttctggctaagatcatgtgcagtatctgttcttaccagtttaatatctgatacatcctctatctgaggataatataataaatagatttttggagcaaggagatggaataggagcttgctctgtccactctacacattggcctggattgcagtacctccaggaatggtgcaccctctctaccacccccaaaaagcccaagtctcaagaggtagtctggaaaaaagtgtttttggatttacctacatttttttttccaagatggagtctcgctctgtcacccaggctggagtgcagtggcgccatcttggctcactgtaacctctgcctccaggattcaagcagttctcctgcctcagtctcccaagtagctgggattacaggtgtgtgccaaccatgctcagctaatttttctatttttagtagagacagggtttcaccatgttggccaggcaggtctcaaagtcctgacctcaggtgatctgcctgccttggcctcccgaagtgctaagattacaggcgtgagccactgcgcccggcctaatttttgtaattttagtagagacgagttttcaccatgttgaccaggctggtctcgaactcctgacctcaggtgatccacccccgccctcggcctcccaaagtgctggcactacaggcatgagccaccgctcctggccgggtttgcctacattttggagatgctgcacaccatgtccctcttttcaagagtcacgtaagtatttacatatggaagaccctgagaaggcacctgggaaaaaacctgtttaactgtaaatataataatgtatgtatttgtatgtggagctcttcttttagtggattatctataaaccgtccactgttcccaatgcatactttggagacagacctacactaccagttttcacctgctagttatttttataagggttgggatggtccatgagtgaacagtcttgatttaaagcagtgtttcccaaacctcatttatttgcctatagccttcctggagtttgtcttatatgtccgctctgtgcactattcctatatgtttttatgtaaatcaatcacttttttaaaaagcctcatcccagttatatccttaaaacaatggttattttttctcatacacatcgaaatacatatctattagaattaaaatgcttgtccatgcactatcaataatctcctcaagtaccatatggtggggacatgtgtttgaagtgttaggagtcaggagtggtctctgtaagacagagtaagtcagtcaacctctgagcactgccagccacacatgctggcagagaagttcagcctgtgacaagactgcccggatatttccatgtctgtgcacggggatgtcctcggtctgccattgtgaagtctgtgctgttttcatgcctacctagtcttctttggaggggcctggaaagcaaatgcaggctgggtacagtggctcatgcctgtaatcccagcactttgggaggcaaaggtgggcagatcacgaggtcaggagtttgagaccagcctgaccaacatagtgaaaccttgtctctactaaaattgcaaaaattagctgggtgtggtggtacgtggctgtaatcccagctacccgggaggctgaggcaggataattgcttgaacccaggaggcggaggttgcagtaagcccagatggcaccactgcactccagcctgggtgacagagactccatctcaaaaaaaaaaaaaaaaagaaaaaaaagcaaatgcagattctccctgggaaacggggggttgggagagtggagtagtgtggatgcattgttattcctgaaggccgtcctcaaattatcttggactcactgcagcaagcagatgcctcatcttctggccagggattgatcctgagatgggaagagtatgagaagagacaccaacagcaaggcaaaactggctctggcagcttgcttcagagaaagagtatagctttggagtcaggccgacctgagtatgaatccaagactcagcacttactaggtgcctgccctcaaaccattattttttgatagtcattacatacccacaatgatcaccatggagtggatgaggaaacagggactcagagaagttaaacaacttgcctgatatcacacaggtaacaaacagcagagcagaattcaaacctaagttgatttgacttccaaatgtgtgctcctaaccaaagcagggtaacctgctttgatttgcccatttcttgagcacctcttctgtaggagggcctgttgctgggtgctgggaattcagtggtaggcaagatggacaagattcccccctctcacagaccttgcttgctataggggaaatagacaggaaaccaattactacatttgtaacttaataacaagtgtcataagtgttacaaaggagatagatactataaggcaccttttatttttatttgtttatttattttttgagactcactcgctctgttgcccaggctggggtacagtggtgcggtctcggctcactgcaacctctgcctcccaggttcaagcgattctcctgcctcagcctcccgagtagctgggattacaggtgtgaaccaccacactctgctaatttttgtatttttagtagagacagggtttcaccatgttggccaggctgttgttgaactcctgacctcaagtgattgatccacattgacctcccaaagtgctgtgattacaggcgttagccaccgcgcctggcctataaggcacccttggtcagccagtggaagcagggtcagtagtgcgccggagagtcactttgaaaaagtgatatttaggttgatcttgaagcattcacaagatgtggtaaacacatctaatggtaaacatgtgatggtaaacattagatgtgataaagatactgatggtccactggatgaacagttttcatatttacttccaaatgatttcatagatattatttcacagataacacttaggatgaaggtaaataaaaaggagatcaattaaaatatgaaataataatagtgaaagtggtaatagatgtggcaatatccacaaaggagtaatggttagattagcatattgagaagatcactttggcaattgttggaatgcagtttacgagagggccaagaatggaagcagcaatccctgttagaagtgtagtgttttggagtgcggtgttttttgttggtttgttttttgttttttttaaaccaggtctcactctgttgcccaggctggagtgcagtgcagcctcgacctcctcctcgggctcaggtgatcctcccacctcagcctcccgagtagccgggactacaggcacatgccaccacaccccgccagtttttgtatttttttgtagagtcagggttctgccatgttgcccaggctggtcttgaactcctgggttcaagtgatctgccagcctcggcctcccaaagtgctaagattacaagtgtgagacaccacccccagccagcacattgtattaatccaagcaggagaacgcagacttcaaaggcttatgggcagcagagagaagtagatgaagcaaagagatgcaatcagcgggactagtgggaaatgagggaaaggaaggtgtcaggatggggctttttctagctgagtggagttcagttcattcccagagaagcttgagaggtatccaactatagatgcaaggtagctggctgttggtcccttgtctttaggacagtttgacttttgtaatacaggcgacctcacagagctattgtgagaattcagagctgggcacagaatagatgctctataaacggtagttctattccccatttgccccgtcctcccagcatgccagggatacaggggcggatagagacaggttcagttccctttggtctcttgcattcccccttccctcagcacaattcctgggctcatagcggatgctcaataagtatttgtagaatgaaccaaagaaatcagacccttggtgacccagggctacatgtactcggcggaaaactggggttaaaccggacccttggttggttgaaaaattaaaataatttttaaaaagtgggcgtgaaataatccagaagttggagggcctggacaaaggctggggaggggactcctcccaccaggcggcctcagggtcggcttagcaagaaaggaggcgctggggagacctctggggtcccagctgccaaggtactcgccgctccaaggagatgcggacgccggataccagctctgcccaagattgctgggtcccgccgcggcctttaaaggcccaccacgtggctgcgcggccagccctggtccggaggcggtgcccgggtggcgcctgcgcactgcctagcagaggggctggggttccgagaaaaagcgtctggagaggaaggggaggctgcttggggtgggacgccgtgggaggagtcggctccttatgcaaatcacagcggagcgcgcacggtccggaggcggggcttgcgatgcaaagacaggtccgtctggcgaacagcgagggggcgggccgcaaccctctgcctctttccgcgagcgctgacgtcgccgacgtgttgtttaaaagcggccgcgcaggcgcagtgagcccaaatgcgaacttaggctgttacacaactgctggggtctgttctcgccgcccgcccggcagtcaggcagcgtcgccgccgtggtagcagcctcagccgtttctggagtctcgggcccacagtcaccgccgcttacctgcgcctcctcgagcctccggagtccccgtccgcccgcacaggccggttcgccgtctgcgtctcccccacgccgcctcgcctgccgccgcgctcgtccctccgggccgacatgagtggggaccacctccacaacgattcccaggtacggcccggcctgaccctggcggccccggaccccggcctggccgtcccgcgacccccggcgcaggccccgaccccagccccggcccggcagctttgacaggccggagcccccggtgaggggccgcctgccggagtagatcggctcgctaggccgcgagcgagggccgcgaagttacagttcgaggcagggatggctgccctctgtggccacccccgggtccccgtcctccccgggggcgcagggtgagccagaccccggccgcgcgcgctcgccgccggaggggttaaagtggctgttgtttgatattctctccttttctttttccagatcgaagcggatttccgattgaatggtgagtgtgccccctgcgccgactccggggccccccagccgccggccgcctcccccgcgccctgccggtgccgggcagaggacagacatggcgtcccagagactaagtcccggctcctcgctcaccggccccattgttcccatcgggccgcctcttgaccccctttccggggaccccagctcctccagatcccggccctcccaagaggggacaacggagaccccgtgtcgtccgccaccgggcctcgggcggtctttccgggccgggattcctcccgggaaagtcgccttgtcgacggtcgggacttagtctctgcgccattttctttttctctctcctctcctttctgtgcctgtgtctctttctctccctccctcggctctttccttgagctgcccagaatgagctttctgcagagcaaagccgtataaatcacatacttcaccagagagggaaggctgggggactgaattattattttttaaactttattttgggggttattccctttatgcttcatgtttgtttccttttctgcttccagaatgaaagatttccttaagcaactgttaattttttttttgataggctgtttatgataggaattatggctctaaaactaaagccacgctttgtggagttctttatatttccaggttgtttttcccaagttacgttctttgcaaaggtagcagtacctccctaaagaaagtttgcaagttctctgtgggtcacccaatgtaaatgttggatttttaaaaaattatgttagtcactggaacttttcattgtggtcgaggttcccaatgcagtgtttttctggaaacgcagtttagtgtacttgttggaaggaaagattgttgagcatctcttgtggacctggtgtgttggccttttcgtttgggttgtaaggaggaaaaaaagattttatttattgaagcaaagagtgtccagtacccacccctgcttcctgttcattctttttcacgagccactgtttttcaggaatcaagaactggctttttttttttttcccaattctttatgtttttgaacccttttcagccaaatcaaggcatttattcttactgtatttccacttcagttacccagggaagagtcctccaataaaaagctcatccttgcaggctttcgaacaaccctgttgaaggagaagttaccttctgtagtgtgctgggaattcccactgattttgatggtacataatcctgctcaattgagtttgggttccgggaacctctccaatgggagaagttgatgagtaggttttctaatgttgtaatcagcagtccatcatgttagcctgctctactgagagcaaccttatgttcagagtttgaagtggggcatccagcaggagatggtactcagccaggagagaatctggtttaaagtatggcatttcttgagcaccagatatgtgccaaccactgtgcttggtgctagagctgatcctgtaaccataacactcccttgctctcaattcagtctattgggggagacataattagttaattataaggtaactactggggcatatgtgtacccaaaatgctttgaagtataggggagttaattttgtctgagggtggggaaatttctcagaggaggtgacttctgagctgggggttgtggaagactgggcgcagagaattgtcaggggttggagtgtttcttaagtacgtttaaccaacctatcacgattttaaaagagggaggaggtgaggcctgcagtttagaaagccacagtatagacatgtttctttgggatacaggagcaaagaaaggatgtgcaggtgaggatgtaagaagtccttttgaccttgctagaggaaggtgggatctttaatatggaatgtgttcttttggctgtcaggctgggctgagtaggtaatgtaagtaatgaaacaaagtttagccctttcttgtgagaaagttaacttacatggttctcacctaagtcacgtgaatgattgtgagctggctaggttattgatctttactgacatttttatagaggctgaagtaatctgcgtatgttgacttttagaatgtgttggctcacatttaatagcaataatagctaatatttattgaatacttactgccaggcatgaatctcagctctttccatggatcatctaattaaatgtaatccttggaaggacccttgtgagttaggtcctgttatttctgttttgtagatgaggaaactgaggcttcagtgtatttactagcttgcccaagggctgtgagttggccactctaaatcccatgagctgagccactatgctagagtgatactatatgatactagcatgaaaaaataaaaagccacaaatctctattttcttacagagctgaaaaaggagagaaggaaggatttgataatttgtcatttgctttttatctaaacatgctttttgaagagaatctgccaccataaagttctgacattggtgtaattattctttgtgaatattgtctggaagatgtggtgttggtaactatgcttgctatctcaagtaatacattgttaaccagtgattgatttatgtaactatgaaaaaaactttaaaaaaagtagaaatcaatgtttaattatgcccagacatgtcattattgaactttgtattaagagattgtttaagcgtgattttaagagggcctaacccatcttacagattaactgtacaagttcatatattaaaatcaaacgtctctcattttgcctgccctcatcccctaagatataaaagattcccccccgtccccccactttggagctcattcttcgcaatatttaaaattgtagctctttgcatgtaatttagaacattctgacccatactcaactgctgggagactctgttatttatatttaaaatgttgacagtgagttaggaatttggagcagaaaccatatctaagtctaagtgaaaagacttcctaagtattggtagaactaactgtagtggggctgagtcattattacagtactgtacaggctgcgtagctatctgtagaattgataatggtaataccaggttaaagtgttagcgattcttctgctgtttcagaggtcttgaagtttttgcctgtctgctatggagatagggagttctcccccatttgacccccttagcaaagcacaatacttggctccatcagtctttagtctaagaagtgatatataggatcatggtttgacatcatcttgtgctgattctggttggcttaatggaatcaaattggatgaaggtaattaaatatgaattgtttctgatgctaatagatagttgtacttctgtctgttgggtatgggttgggatgggcggtagcatagctgattgcggtgggggaatttcagatagctgatgatgtggctatctgaaaattgccactacatttttaaaactgaaaagtgatggtaccgccaaatgaaatctgcagcatcctcagactcaatcaggaaatacttaagcattatgctccagggtggttttcttcccttacattgcaactggactccttgaggcacctttttagaattagtgagccgctaggatttttatactatgctttgacataaaagaaagttgcttgtcaatatgtgtttttttagtttaccagcatatcagatctcacaaacaaattttaggctcggattggatgtttctagtaaaaacaagaaaatccaggcatcactaaaagaatcagaaatacgttgtggcttgaaaggtgcaaactaaataatatagctagcagtaacggtcaccaactcctgcttttctttggttcagtagatagagtaaaatggaaaataggaaaccaaggtcagtccccaaatctcattttaaccaatagcagcaaaaaaaaaaaaaaaaaaaaggaattgagtctgactttttccccttgctgtcagcataaagatggggaattgagagagttggaaagacattcattagtttgttcagattattaaataacatgtcttaaagtttatattccaaaattgggctgtgaggtttttttgttttgcttgttttcagtgcatgtgtggggtggggaggtgcaaaaaaatgtttgccttctaatatacagctttgttgtatattaattatatagtaacagttgtccctgctgctaatggtatggaaaatgattctgttgtgctttctgaatacatatcattttagaagtttcagattatactaaaaccatgttatttcatattagttggacatgaatgcatatttatatgacacatcattatcaacttttgccttttgccatctttttagtgcaaagtaaaactgatattcttcaaatccaaagtcgtttcctcagaagtgtgttttgtgagggattgcatctttcccatgtgaaactgtgtcgaactccagtaaactgtgtttgcttgggaaaatgaattcaaatgtaattagtttgaatgaagctgtggaaatgtttgaaatgagtattttgacattggacctggaggtttaaaaaaaaaaaccctattgaaagaatagtaaaatatattggatgtggaggtgagagtcagttgagtgaattttctgtgttgtatggtttagattatctgactatcccttaattattttgaaaccattaactttggataataagggcatttaggcaaacagttgacacatggatttcttaaggtaaaaagtttagagacttccaaactagtccttaagaggcgaatgggtattgtgtttaaaggaagctttcagattgtgtttaaacttcgagtagtaatatttggaactgtcttttctccctatttccatgcctcatacatctcaagtttgagcagcagctttccatccccatggctccaggccaatagctgcagtagaaaatctaaaatagaggccagggttggaataattagcattttgccaacccccaccctccctgccacctgcctatctagatgtggacagtatgtgctgtgttgatagcatagggcctgggaagggtggagagggatgtaaatgagggcagggtggacaaagtttgattgggggttgcggggaagcttgtagaggaatgtctgttagatattgatggtattttggtggcgttatgagaaatggctgatagtttgctgaaatgatttaatagtaaatagatattgttgaacattttctgtgtgtataggaaagatcctagatatttttcacactgggagagaagtgatgttactggtatctcatgcatatctctggagtatatagatcgtaatatcaactttggctatctgtatcgaagtttgtattaactgtctttatgtgtgtcatttatgtctcttaacgtttagtaagaaagaaattccaaggaaggtaggcaacttttaattttaacttctttcctttactttttttttgggcggggtggggggcagacagggtttctgtttgttgcccgggctggagcgcagtagtgtgattgcagctcactgcaacctctgcctcctgggctcaagcgatcctcctacctcaccctcccaagtagctggaactacaggtgcatgtcaccacgccgggctaatttttgcattttttgtagagacgaggtttctcgccatgttgcccaggctggtcttgaacccctgggctcaagcagcctgcccacctcagcctctcaaagtgctgggcatgagccactgtgcctgacccttaatttctttttggtaggtattcatttttcatttgttgtcttaagcttctagtttcactcacttacctgtctgctaaatttttctgaaatgtgtaataaatgttttaatttaccatctcccttctacccttcccatcagatttggggtggggaggcatctctaccaggcaattaattcccctctgagcctttgaaattaacatttttgtttctgtggattcaaggagcctaaagaacacagttcattagcattcctaagaaacacctaggtaagctccaacaaaagatgttaaagcaatcagtatttttagggacttcagatctcctgtatttgttgttgtaaatgatgatgttgggaaaagaatttaacagatccctgggtattctgacgttttcctatattttaagaacgaaaccgacccagccagcttgtggtcccattattctttatattgtttttcttagcacacgctagcaaagatagatgcctaggacttttcttggctattggagtttatagaaaaaaagttctttgttgaaggttagtcctccaccagaataatacaccctttttccccttagtagaagtccaaatgttaatcttgctatcatatatgtatgaatgcccagatttataaagctttgtaggtatattactgattgtgcaggagactaatctaggaggcttcaggatcattgtcatttgtggatctcattggctaagaccttttacttaacctgactccagtaaggtagcccctttgtttccttgtagttgactatgtgagctcttgccaagcagcagaagtgggatgaagggaactaattttgaaaacttattaggcaccacatttttatgtgcattaaatctgaattgaataaagataatatagattgcataggcttatggggagaaccagagaccaggaaaggaaacgtttttttctttttaccctttatgccttttcatgtcccctttttgataacatgctgccttggtccagattctggaaaccccactcaggctgtaattggtaagcttctagtacagatgtcagaacctgcccttgattatctgctgttagagatagcttggaccctttgtatgtggaatgttaggtctaggggaagagtgggggtgtgaggagacagctgtggtaaaatagaaaattggtgtaggattccgaaaaatcgagataagtccctgttcttcctatgaaacatgatctgaccactgaaccttgttttcttatccataagcaaggataatatttatgtttcacaaactgttgagaattagataagtatatgaaggtgcctctctgtcctcattgtaaaatgtaaactttgatgagacagcctctattctcaactggatctttattttgaatgttaggtttgaaatagtgattgatgttggggagtctgtctttcattggtattccctgttaaagttttaaatcttcttgacatttacacagtgaattgtaacatgtaactagtgttgttgagtctttacctaattgaatcagcagagcctacactgatgtcttccagttacaaagcggtcactgtaaagtaaaaggtgtcttcatatctaggtttgggctgagaaggatccaattgtatatctagttcctacttttcttttttttttttttttgagatggagtctcactctgttacccaggctggagtgcagtggcgcaatctcggctcactgcaagctccgcctcccaggttcacgccattctcctgccttagcctcctaagttgctgggactacaggcgcccgccaccacgcctggctaattttttgtatttttagtagatacagggtttcaccgtgttagccaggatggtctcgatctcctgacctcgtgatccaccagcctcggcctcccaaagtgctgggattacatgcatgagccaccgcgccaagcctaattcctacttttctaagaatgtttacagcaaagtggtcattgccaaaggaacttgtagcagtacagaagatgggctcagaaatgaaagaagtctattgatgtgactaatttctcaaccatttaatagaattatggattttctattaaaaataacttgacccttttcgatgcatttaataaaatgccaagttcattatttgttaattttttaaaaccacaaaattcaatatgtcttgtgtcagcatattttttcaaaggccactattttacttctcccccaaaacgtttttaaattaaacagagaactctcaaagcacctgagaattacttcagtttttcatttattcaaatagttgcttaaagtgaccaacttggttttctttgaaatagtaattcttgggaataagaataccttaaataatataataaagcttatgtgtgagaatttagtaccaaatgccgtgttaacagttatgcgtgagtataggcatttgggagattccatgaaaaaatttgataaagtcagtagaaatttcagtaatggctcataagtctagctaatgctgaatattgaattgccttgaatttgtttttttggaagtgttacttaaaggaaataaacaaaagtcatttaaggatgtgttcactagtgttcattaggtttaagccaaatggatcttagtagagatcttacgccattcagcaaaaggattatcacagaagcatcacaacaggcgcagacttaaattcaattaaaagtaggcaggaggacataattttgttgtatagaaattatggaatagggcctaattttaaagagtcttcaaagataaacatatcaggaaaaatatagctcataaaatatggggaaaaaaatctgggaagatgagtatttgttaatgctctgtagctccattgccctcagtatacaaggaatgtgcccacaatagggttggatttaaaagtcttcaaagctttggtctctttttctttcgttttcctctgatacagaatgcgaatagtctcccggcctccaaccccctctacatccccaccaccccataatagagacttaaagggaatttaaattcgagttcttgagcttctgctcaatggctaggtctttgaacaagttaatatcagagccttagttcttcacctataaagtaggtttaatacttaccttacaacattgaggattaaagagcatgagaggattactttatgaaaggtgaagcttagaacagaatttttagttccttgccaatgctaaaaaacaacaacaacaacacctttttcagaaattgctttattaggcttttgtacaaagggaacatctttactttctttaaatttgcacatatatctattgtgaaattttaaccaagctggaggggtcactagggagcattgagtatgatactattgctgtaaatcatagaaaggctggctcaggagggtactgacttgctttgactttgcggcaacttcagttgtccagtgacaaggcttgctgcatacacaccactttgtttgtttctcataccttaaattgtggattaaaaatctttggggcaggcctggaggctcatgcctataatcccagcactttgggaggccgagatgggcagatcacttgagcccaggagttcaagatcagcctgggcaacatgggaaaaacctgtctcaacaaaaaaaatacaaaaattagccaggtgtgttggtgcatgcctgtagtcccagctacttagaaggctgaggtggaaggattgcttaagccccgggaggtggaggttgcagtgagccgtgagcatgccactgtacctaccccgttttgggcaacagagtgagaccctgtctcaaaaaaaaaaaaaaatcatcatcatctttggcagtgattaactttctcctttcacacttgggatggtgcaatatttggcatctacttaggaagctaaaattttcacgtttaattgtaaatggaaaagtttaagttgccatattcattcatacaaacattcagaaagtgaatattgtgactagacacagatgaacaagacaaacccacatgcctatcaggatgaactttgaaattagtacgttgtaggtatatacagtcacttcctctgttgagatttttcattaggcctcagtacaaaggctgctgtcatacaacatgaatggggactggaggtactttctggcagttaatatttcactatcagtgcaagagagtgacgtctccatttagtcctaatcgtgagtttttccccccttaaagaaattggagacctaggaccttggatttccaaagatttccaaactcttatttcttaaaatgttacaaaaaatggtttttttttgtatacctatatacccattaaacttttttgcctgaaataggcaaaaagatttaagttctgtgtatttatttcctgttatctttttgtatcagacatccatgttgcatgaattttagaaaaatagttttcagctgggcttggtaatggctcatgcctgtaattccaccattttaggaggccgaggcgggcggatcacgaggtcaggagatcgagaccatcctggctaacacggcgaaaccccgtctctactaaaaatacaaaaaactagccgggcgtggtggcgggcgcctgtagtccagctacttgggaggctgaggcaggagaatggcatgaacccaggaggcggagcttgcagtgagccgagattgcgccactgcactccagcctgggcgtcagagcgagactccatctcaaaaaaaaaagaaaaatagttttcacatttcctgagcaggtaggttgtcggaatggctagagatggtcacattctgtgtgagaaatcatgtgacaatagctaattcaagtatttgaaataatttaaatccttgaactgaattgattgaaataaagtatttaaaatcaccatcttcacatatttgaagaactaaaatcttagagaataaactctacttaaagtcctgggaaactaattttatgaaactattgaaatattattgccccttcctaatccatgaagtatcttgatatgggtaatacataaaagctgttaaagctcttcagagaaagatgcagagtacatagtggtattacttacagtggtttgaatactagaaaagtgatcgggacaaaatgttagacttactgtgccttaatcatacagtcagtgcatttttgcaggaatggatgcaatgtaagtagttcttactatttaataccagaaatgaagaaacagtagcttcttaggaattgattgtggctcaggatctatttcttaatttttaatgcttccacttaaccaggagaggaaagggaggagaaggaacacaaatttgttagtctttataactactggcttgttacacttgatttccaaaccacaagtgctccagggccaggcaccccacactgagaagtccctaagaagtgcatttattggaaatttgatttttaaaaaaaacctcatctctactaaaaatacaaaagattagctgggcctggtggcgcatgcctgtagtcctagatactcaggaggctgaagcaggagaatcacttgaacctgggaggcagaggttgcaatgagccgagatggcaccactgcacttcagcctgggagacagcgaggcatcgtctcaaaaaaaaaaaaaaaaaaaaagaccatgttaggttctgtttaagtagtatttcttataccctggaatgaatgaatgcctcttagtctttagaatttcataaggtttagctaggtatactcaatacttctccattttactacatatttttaggaaggcactaggtattgtgaactccttgagagttctaaacatctcagagcctgtttgagtattgatggcatagtcacagatactccatttcctttctagggaagtctgcctgcattaccacgtaaccccaagccagaagtgtaaccacttttctctgacttgcattgagcttttgttatcctcttttaatatttcattctgtagtagtctgtatttatgtgttttccttattaagaagtggccagcactttgggaggccaaagtgggtgaattgctttagcccaggagttctaaagcagcctgggcaacatgtcgggaccccgtctctacaaaaaaataacaaaaattagccaagcatggtggtgtgcacctacagtcccagctacttgggaggctgaggaaggaggatcagttgagcctaggaggttgaggctgcagggagccatgtttgccctactgtgccccagaacgagaccctgtctcaaaaaaaaaaaaaaaaaaaaaattaagagcactgtttcatcctgtatggtcaatacagatgcttttaccaaatgtttcagttgtgaagtgcaaactcctttctccccccagctggttgaagatcaagtgggagacttttgagagcttaacagtaagttttccttgtttttctcaagctgatatgcctaaaagtcacctggggatgattggtgaaaatacatattcctactcgtacaccttgaagttgattctatagtggaaggtactgaaaatctgcatttttaatgtatcttcaacaatcccaaatgattctgactaatgcaggtgacccataacctcctttggagaagttgatctatctgaactttactatcttatttggctaaagatctatattttgcttcattcaattacgatactccacaggttaaggtataaagcttacagggtgatgatgatgatgatgatgattattattattattatttggagacagagtctccctttgtcgcccaggctggggtgcagtgacacgatctgggcttgctgcaacccccacctcctgggttcaagcgattctcctgcctcatcctcctgagtacctgggattacaggcacaccaccaccacacctggctaatttttgtatttttagtggagacggagttttgccatgttggccacgatggtcccaaacttctggcctcaagtgatccggctgcctcagcctcccaaagtgcttagattacagtagtgagccaccgtgcccagccaagattacaggatatttttaaaggaccagaacagtattttttaatatatgtttataaaagcttgatacttcactctaagttatagtttctacctttcagtgagcatttaccaaatagcagatatagttaactgcctttgcagctgttttactgtgtgtcagaatcctaatcctttctcctacttcagtgtttaacaagccatttaattctgatgttactttttcggattgggtgacaagcagagcacaatgagcagggtttgttttcatactaatactaggatggttaaatcaggactttagaaagtaagtggaataatttagtggaatactgaaaatccagtctgtggagctcactgcctttagattaaattagttggggacttcagctcctgatggtactgattgaaatggaagcatttgaataaagcagtatagttgacgcttgaacaacacgagggttagggatgctgactcctatgcagtcaaaaattcgagttataacttttgactcctcgaaaacttaactaatagcctactgttgaccagaagccttactgataacagaaacagtcaattaacacacattttgtatgttatatgtattatatactatgatctcacaataaagtaagctagagaaaaggaaatattaagaaaattgtaaggaagagaaaatatatttaccatttattaagtgaaaatggatcatcataaaagccttcatcctcattgtcttgttgagtaggctgagggggaagaggagagtttggtcttgctgtctcaggagtagcagaggagaaagaaaaccctcatgtaagtggactcaagcatttcaaacacatattgttcaggtgtcatctgtggttctcaatgtgtggtttcctgatcagcagaactgcattgtttgaaaacttgttggacatgcagattctcgggcctcacccatacctactgactcttaaactctgggagtagggtcttagccatttgggttttaatgagtgtctaccaggtgatcagatgtgcactgaagtttcagaaccaatagaatagagcaagataccagttttgtagtaattcaacctcttaagcagtattccttgttctttcacaaggaaccatgtatggagttcattacttgtgctttcttacagttgtgaagttggagtaattcataatcgggggaggatcttctggagtataaaaaaatttaaggagcagttatatgattaacaccagaaaggtttcttgtatttctactgaatatatgccacttcagtaggagaggtgtgttcagtcttattctttctacagctagtggcccagagaatggcctgcgcatttcaagccctgtcaatgagaattgtctagacaaagaaggtcccttggttgaattagtaataggatacatgaaacaatgtgtcagcacacttaaagtctttatggccagacaaagtatggtcttagtgtgtttggaggcccctgaccattggaaacaaaggcagtttaggctgagctgtggatccgcacgtaggccagaggtttgtagtcactctcactcttcccaggcattaagcgttccttaatggaagcaaaggaggacaagcctacaggaatgggcctgccctaattgagctggcctgagaagatacattttcaggttagacaagtcctttttcccttttaagttctgcctcttgggaaagaagatgcatttgtagtgcagggatgtccttgtgaaaatgtgacttgttatagagcagtatttgaaatgcaagtgcccagccgggcgtggtggctcacgcctgtaatcccagcactttgggaggccgaggcaggcggatcacctgaggtcgggagtttgagaccagcctgaccaacatggagaaaccccatctctactaaaaatacaaaattagccaggcgtggtggcagacacctgtaatcccagctactcgggaggctgaggcaggagaatcgcttgaaccctggaggcggaggttgcagtgagccaagatcatgccattgcactccagcagggcaacaagagcaaaactccttctcaaaaaaaagaaaaaaagaaatgcaattgcccatcttaagggtcttgtactagttaattactttcagagataagtaaaaaaattccagtgttgtcttctattaagagagcaaaggtagttagtaaaaatgggatttgtttgccctgctcccgaagcttaaaataattgctctatctcagttttgtcttatgcttcggcagactaataacttcagttgaaatgttttctgggcaggtgttcattgagggcctgattctccagaggttctgtgcagaagcaggctgctttgagatagccagcttagccaggcctgggaaccacacagaatagtgcagtaccatgtagggaaaagtccttgactgggctgcaataggcagagtggagagtgctaggaagcagagtattttcctggataatttcatccagtagaactttttgtcatgatggaaatgtcctatatttgtgctgtccaatatggtagctattagccatatgaggtgtgtctgtgtgtgtgtgagtgagagagagagagagagacaagagtcttgctctgtcattcaggctggagtgcagtggcgcgatctcagcttactgcagcctctgcctcccaggctcaggtgattcgaccctcagcctcccgatagctaggattacaggcgtgggccaccacgctcagccagtttttttgtatttagtagagacggggttttgccatgttgaccaggtttgtgtcaaactcctggcctctagtgattcacctgcctcagcctcccaaagtgctgggattacaagcatgagccactgcacctggcctatatgaggttttgagcccccttgaaatatgtggtaagtgggaccaaagaacttaattattttattttattttattttaatttaaatataaactagccaatagtggctaccatattggacagctctagataaaatttaggtaagacccaagagattgtggtttagattctgcttggaatatgagtgattggggctcttggaatttaaaaatccaaagacacgtgtgaatttgatgttatgagtttgaataacagccttccttcagtatgtctacattgttttatcctgactgacattgtaagtcctaagaggacttacaactggtaagtaaagttgtgtttaccaaagcagttggaagttcaggcagttgtacgttttatttgaccccttagagctaaacaggtgaaaatttcaggtcctttggatgaagtaagttctcattttatctcagcaaccctatgaggtaggttatgtctgttgcgtagttgacaaaacagatgaacttatatttatgtacacctttatggattagtagcctttaaaatggttagttttatcccacaacttcatttgaaattgtaagtttctagcatgttgcctataacaagaaggtaatttatttctatttgttaaattgttatcagtaataagtcaatatcctactataagtggtagagaatcaaagattgtagactaccaaatagcacccaagaggctaattcatgcaaggtgttgcttatagtaaaagcagatcagaactcagctgctgtatgccatctggggttatcttctcacttgcacgctcatgaccagtgtaggctgcatcttataagtaatctggctcacagttagctagacatatattagtctgatggaacaaaatccgattgtagctttgaccactatgaggaccactgtcatataaggtcttagataccaacttgagtaaattgcttaaggactgggaatagatccagattcctccaggtttagcttcaagttgtgatcagttttcgtgggatgcaaggagaaaatgaataggaatgaaataaatagctgatatttgaacatttttaatgccctaggcagcgtcttaagaattctaagctttcatttatcaatcctgaggtagttaacattactatttccagtaatgttcactgggccagtttacttttgaagaaattgaatctcacggtttaagtaaagtaactagctcaaggctatatagttataactaagccacagagcagggaggctaatctaggcctacctcatgccacagcctgagttcttagttgtgatacaaaacaaggtaaagggggacctggggtgacttagttgcctcctgagaattctgggctgtggtggaattacccatcagactgggggcgcccatctcttcacttatgatgtgtccttaacagactaaatgcaggctctgctgcactttaatgtaattctttccctattaagggaagcttgcttgcctttgcagcaaagccccctggatagtttattttttagcagttcagcttgtgcttggacccagttgttccagaaatcagtaaaacctatttgagtattcaagaaaaaggatctttttgttaactaaggattaactagaaaccttattttataagggttcctgaagtctgcttatttactaaggaatttcatcagaggtggttagcattttgtgaacaagtatgatgttgttcccacttcaaggggaataaataacaaatttaaccagcttgctgcttaagaagcagaattagcagtgggccagtcattggcctctcttcagagttctcatgtgactcacttagttttgcagagtgaggtagattttaaccactttcaagtcaagttgattggccattcatgagctgtgtgcagggagagaagagagacgagaacaagttagcagaaagctgaggtgtgttagacgggagttgtaggtaagtcagggaggatattcttcatttagaccctgagcttgagtaagacacctttctacaggagacattgcggatactttctagttagtactagcgcagtgttctgcaaactacacctgcttttgtgtggtccacgaactaagaatggttttgtatttttaaatttaggcatgtgccacataacaagatttctgtcaacaatagaccacttatataatgatggtcccataagatagaaggtggtatttttactgcctcttttctgtgttgcagatacgttcagatacacaaatacttaacactgtgttacagtttcctacagtactgtaacatgctgtacaggtttgtagcctaggagcaacaggctataccatatagcctaggcggtagtaggctataccatctaggtttgtgtaagcacactatgatgtttgcatgacaaaatcgcctaatgacacatttctcagaatgtagttggaggaaaaaaattgaaaggagagtattacttcatgacacaggaaaatcatttgaaatacaaattccagtgtccataaataaagttcactagaatgtggccatgctcattcatttacatgtaatctgtggtagtttttgtgctactgtggcagaattgaatacttgcagtggaacttgaatgggctacaaggtgtatttagtacctggcccttcacagaaaaagtttgctgacctgattgaatgtgcttgtgtgtatcacaggaagctcaccaggactcttggtatgtagcctctagctcccaaaggcatctgagccccactggcaggactcagttacctgtctctgtctaagcatgactccacccattagcgtccagacaacgaagaaaacttctattttaaagagcttgactaaccccctccttattatctaagttagagtagctgtgccaccccttaagtagcttttccttcttcctttcaaataggggttggaagagtagcaggtgagaacaacctctttcttcctcaattgtagagactcaatagtctaggctataaattaaaaaaaaaaaaaaaaaattccccagaggctgactcagcacatgcctgccttttaaaggaacagagagacccaattggaatagaaactgaaaataaaatcagcagcacatgaatttttgtaggtggctcgtatttgctattaatattgctcagaagactcaggaataagaaataataatgcagggtttcttcaaaatatggttctggacagtggattatagttacctggagagcttgtgttaaaatatctgaggatgattccaagtaccagggcttatacacaggaatacttgagaaccactgcactcaagcatttaaaattttccttttacctaaatccacatgggccaagacaatttttaaaattcatagaattcatgtgaccagacgtaaggggtcaataaaggtcattttatagatcagaaaactgagacccaaagctgagaaataagttatctaaaaccccaccaggacattgcattaaaggagttgctctaagcgtgtcttcttactattagaaagtgaaattgacttttaaatctgtcacttagtttttggcataataataaaacaatgaacagtctgttctggctctaattgcgcctagaatctccagatcagaagaccttcttgtagatcaagtaacatacttctctgaaagacagtttgtcggtcctatcactgaagtctgaattatttttttgatttttaaatataattaattggtccctggaaatgagaaccagaggaagataagaagatgaacttgaatttaaggaccataatggaaggagtgggatgggaaagaaggctgtaaaataagacagtggttgtggagagacagattaaggtaaggagagaaggttgtaaaataagacaggaaggggttgtggagagacagattaaggtaattgtggtgttgtaaagccataaaagaaatttaaatgcggaagtggcctggaagagaaaacattctctgatcatttaacccttttgtgtgtgtgtcagtttgaggcgtaaagtagacgaatagcctccttcttgtgtgtcttttccatggcaaagcctttaaggataatagctgaccactaatctcacacagctgctgatgtttaagaacctaattcttgaagtgtttttaagtcagtttgtggcatttcttctgaacacttgggcactttggaaattgtagtgacaggttttagaaatttgaagttgtgttgcagaggtgataacaaaattgggtctttgagcaactctgagtcttttaatgcagtgcacttctaagtttccgatggtatttccccaagttttgaatattgaaaagaaagaccacactttgcaaaataattggcaactttcatttaattcagtttgaccctgtcttgaacttggtctttgtaacttcttatgagggtcttttccaacggtaacattagaggctgattctggaacttcatggaggcaagtccagtgaaacttgggcagttagggggaccctttccctctcccttttcaaagttactcagtcagcagctgctactgttgggatggcgcggtcaggtgggtattatgcttattatgaaacttgatgagggcagggactcagttttggggctgagttgtatttcaacacttaagtggcactcagtaaatacttgaacaaatgaatattgtgaatcccaacttccttaaggacagaagaactatttatacttgtctgccatcttcttagctagagattttttttttgtttgttttgttagctttcaagttgaggtccctaacaggggaatcccatagtttcaatgatgaacaggtccatgacaaaaattcttgtttatatgcaatacacatttagggagaataaatggtcatgtggactttaaaaattggaaatgttactagtctcttctctcattcttttgttttgttttatgttgaggcagagtttcactcttgttgcttaggctggagtgcaatggcacgatcttggctcactgcaacctccgcctccgggttcaagtgattctcctgcctcagcctcccaagtagctgggattacaggtgtgcatcaccatgcccggctaatttttgtattttttagtagagatgggctttcaccgtgttggtcaggctggtcttgaactcctgaactcaggtgatccacctgccttggcctcccaaagtgctgggattacaggcatgagccactgctcccagccctcattcatcagttttttaagggtttctttagagctgaatcctcccagcagttttctttccttttgaattccagagctctttgggcctttagccagaaacagtctctgtcctgcttactttgaaaggctgttaactatgccctggaattttggaaatgttctccttgagaattgctgtaaagtagtgataaggactcttctgtaggctacaaattgaaaccagccaccattaagatggctcacagacagggtgtcctggattgaaactggaccaacgttggtatagtctgaatttgaggagtaaaaagaaatatgcccttccctctcccctaacagttggggaatacttgtttttactcctcaaccattccccttttaatgatgacaagttttcaggctttttcactgcctttagttttgcattaagttcctgggagattcacacacccctgatatttactgcactcctggatgccagttttttatcactcaagaccagcttgttatctgtcctagacagaagccatcttcttttaaaagtattagaacatactgggtatagagtgttaaagagaatgttgatttttttaaaacttctgcttttggggatgtgatatgggtttgaaagtcagggaggaagtagaagatgtaagggtttgccccagtacaagagttttaataatgaggtgataaatattttctttaaataatttattcacccattgtgttcactcaagtggttctagtgttcactttccttatgcgctagttgtatatttgtatgtcagagaagagcagagattatctttgacagaagttatattgtgagtgtctttttggagaaggtaggttttgattgtgtaactatgccacacctccattccccatacacttgacttgatgattatctttgaaggaggagcccatcatattatacagctgccctaagtctcaaatctatcatcaaaaggcagtgtaaaggggactggctcaaaacatggcaaagagtctcctttatatcagaaagctctctgcctttgcttataaggcagcaaaggactcttcttcctgccctgatctgattaccctaaaagctttaagatcatggaatagttgataaaacagtcagtattctgtgctgatgacttatccttttctcccttaagaaagagtaaatgtttttgcttggattgagtttagagacaccagatagaataagattggcaacactgttagccacctgctgaccacagctaaacaggcatatgtgcttctgcatggggaatgctatggcgttaacagtgccttccttaaaacctgtaagttcgttaggcttccgggtaccagggttgttagagtaggccacagtttacttcctttttcataagtgcttttctttcctggatctcagtataggaaggaaaatcagacagcatttctcagttgttggctcggtgggcattgtgaatgggtatggttgctgcctcaaatgcacatatacaacctgagctaagttgtatgaaatgattgagtaggctgacttcagttctatgtaaattaatcaaggagaaggtttaggaatggttgtaccgcattgacagttgttaacatgtttataatttcttggagattagccaggaattctgttacaactacacacaaatattgattgactttcaaaataaaattctttaaaatcactgaaattttctgagcccaagtttcttcatctgtaagataagcaaatttactaaggtcatgggtatctagtacatgatggacagagatttgaagctctttaccactgatttatgctaccttctcatagatctagtagttaagtgacttttacccaaggtcatacactgagtgatagaacaaggattttgaataagatatttttcactgttgcactggtctgctttctccagcttccttcagaggtccctaaaggggacctctgtgctgctctgcagtgcctctatcacattagggtttggtcatggtcttttgtgctcatcatgtttgaacatgtttatcaaagtattttacagacttggttatttcttcccctcatgtaatttgtgtatttgtctgttttccctatggagaatgaactttttatcttatatatgcctgatgtgacattgatttggccacttggggttgaccttgtacttggtttccatatctgcagcttcattgtcattttgggtttaggccagctttcaggaactttttaacagttggatcaaattttgttggattcatttgatactgagtttcttattcctgtatattttgtttcctttctatctaagcagagaactaggactctagagttacaagaagttagagtatatctataacttttttaaaagaaaaaaaaaggaccaggcatggtggctcactcctgtaatcccagcactttgggaggccaaggcaggtatatcacttgaggtcaggagttcgagaccagcctggtaaacatgctgaaaccctatctctacaaaaatacaaaaattagctggccatgatggtatgcacctgtaatcccagctactcgggagcctgaggcaggagaatctcttgaacctgggaggcggaggttgcagggagctgagattgcaccactgcactccagcctggacagtagagtgagactctgtctaaacaaacaacaaaaaaaaactctgttttggacacatgactttagggagataaacataactctgggattttattttttaatatgctcctgaaaacagtcaactctcccatttcctagctgggagaagtatgtctcacttaattttgctcattcaggagaggatgaatttttcagcaatgatagtaatagctggctgttgcaactcatttcttgctgcagcgtagcacatccaccaagaatgccctttcaccttcctttgtcttgccaactccctcttagctttcagtaagacttggctcaaactgcatcctccaggaagcctatgttaactcctaactgccactcttggatccagggtttttatttcatcttgttcgctggtggaaccgggctgttttatctcattatattactcttcactttgaaacaaggaggcagttaacctagattcagtatttttactcttagactttttttcccccaaaatgcccataaattaagcaatcttactgccttactgcgcttactgaaaaatagcagcacagcagaaaaatagaaaatcttgctatcatgtaagagatgtggaagtaatggtgcccacatgcttcatttggaaaatgtctattacctttataaagagtttgtatagtttctaaatacaggagcattatgatgcgatagaaactgttactttaatgttaattgacgttcgaaaatttgagtttcaaatgtttcctaaaacattttttcttaacccttttgctattccattgatctgccattctacattctgcctcctttgtttccctgtcacttattaaaaatactgcctcttaactttgttgtcatccacttatttctctagatacaccttggagtgttttttcaggctgaattgttaggcatgggattgctgggtttaaagagggagtgtgtgagtttgtttgattttgccaaattcttccttcatgggggttataccaactagatgcaccttattttcagagatggtaaaatgaggcaaaaagtatcttagatttgaggaaatcgttaccacccagagttgtgaaacttagaggtgatatatgtaatactgccttgcacaaaatatacatttagtaaaggatactgatatggtttggctgtgtccccacccaaatctcatgttgaattgtagctctcataatcttcctgtgttgtgggagggacccggtgggaggtgattgaatcacccgggcagttacctccatgctgttcttgtgatagtgagttctcatgaggtccgatggttttataaggggcttccccaccccgcccccgcacctgccccactttgcttcacacttctccttgctgccatcatttgaagaaggacgtgtttgcttccccttccaccatgattgtaagtttcctgaggccttcccagctctgcagaactgtgagtcaattaaacctctttataaattacccagtcttgggtatgtctttattagcagcgtgagaatggactaatacagatacctagatacccattattatcttttgtgaactgggactatttctctatcgtaagagtggtaagaaacttgagttgagatagtgtttgaaagcacgctagcatggtgctggcacccgtattagtgcccttttctcttgtgtgccttgggcagccagctacttgagattatatcttaattaccttaatggattgtaaactccttgagggcagagtccttgtctggtgagtctttagcaggaagctttggacttgaatatatttggttttaaattgaattagtcttcagaatatatttctgaaacagtaggaaaaggatttcttttttttctttcttttttttacacattagccctcaactcctgtgtaatgctacctaacatctattcctacagtaggaaaagacagagacactttccttttgtctgtcggaagcttctttacttaaaagctttttaaaccccagggaatacgttaggtaacaatagcaaaagatgttgattcctgttctatctgtttaacttatctgtccttagggagtaactccagttaaattacagtgaaaggagttagttgccataagtcttctgttttatcaagattgctttattgcagggggcttcctcccatgtcttcatctagaattttcactaggaattaaaatatttgttactagaaagcattagttggcctgaattcacagtgaattaggttttctgatgatttaatgtgcactggtttgcatctttcatatctgtcagttaaattcaacacatttctttttgcacttaacaggtgcttgaagtggcagggtccttcctctaaaacattttaaataacactagtagatgaattccagttaaggggaaaaggtatgtgctgaaagtaatcttcaaggccacagtatgttctctccaaacacatgttttcaccacgagggatgtagatctgtgtgcccttattggctttactttttcacttactggcatctcttctgaccaacatctttagtcagatgtcccactgttaccttagatacaatatggctcaggctggtccatcatttctccagtatttttcaccatctttattctgtacaagtttcttgtttttgccaaggccccttgttcccccagtcacctggacgtaaagactttctctgactctttattacactgcatttattacacatagtagtgagttcctggaactgggttctacttccattttcccaaatgtgcttttacattttttccttccttcttagttcctttgctgtcactttttttgtagattgcttcagaaacctctaactatttattttgcttttacttttatctcttactatgccttaacacaaaccctctcttggaactaggccagtcttcttgccatgccctcacataataacacaaaaatgaagggttggaaaggaagaagcttaaagataatgtttaacttatgaaaagtttcaagcatacacatagagaaatataatgaactcccatgtgtctgtcactcagcttcagtaattaccaaccttttgccagttgaattttgtctatccccgtatcccttggtgctcccccaaccaccaccaccagagagtattataagcaaattccaggcatcgcttacatggaagtacttcagtattcatctttagagattctttaatctgtcagtttacctactgcagaatatctctacagtttccctttcagttggttatttagtttgtttaaatgcttttggcgttcagaaggcatcccattcttttagtggttagttcttttgtactgacctcaatttgcctccctatcatttctcagcagtaatataaatttatatttactcagaaattacaaatttactgagtaaatttatataatacaatataatagtcattaagatatttgaagaagttgccatgtaatacactttttgacacacctttcacagcacacatagcacatgtaataacttttatttgtgttttagagagagggtcttgctctgtagcccaagtggagtgtggtgatgtaatcatagctccatccttgaactcctgtgcccaagcagtcttcccacctcaccctcagagcagccagtattacaggtgcaccaagatgcccaattaattttttaaacagttttcgtagagacaaggtcttgctatgttgcccaggctggtctcaaactcctggcctcaagtaagcctcccaccttggcctcccaaagtgttgggattgtaaacatgagccaccgtgctcagccattcctttaaaataggaatacttggggttcagatctttgacctaggtcttatttgtatcaatgagattaatgagccacagccccgagtttctcaccagacatttttgatttgcatttttagacagcagttgctttaaaaaacttggggacctggcttaaaatcaattttgaaattttgtgcattaaaaaaaaaatgtggccgggcgcagtggctcacgcctgtgatcccagcaccagactttgggaggctgaggcagatggattgcctgagctcaggagttcgagaccagcctcggcaacacggtgaaaccccatctctactaaaatacaaaaaattagccgggcatggcggcatgcacctgtagtctcagctactcgggaggctgaggcaggagaattgcttgaacccgggaggctgaggttgcagtgagccgagatcacaccactgcactccagcctgggtgacagagtgcacctgtagtctcagctactcaggaggctgaggcaggagaattgcttgaacccgggaggctgaggttgcagtgagccgagatcacaccactgcactccagcctgggtgacagagtgagactctgtctccaaaaaaaataaaaaaaaaaaagttattggcagactgttatctgaaacctgcctggaattactttcaatttatcctttacttaatttcctttttaagtttagagctttttagtgatttaagcaaattttcctatgtacactagtatttgtcaagataaatttttaaagcttggtccattttttactataaaagtaattgtggggaaaactagaaaacaagatgaagtatatgcacaaaaactcaagttactcataaattgactaccctaagataactgcttttaatattttgatgtctgtattccagtcttcttcatatgtatttatgcgtttgttgaattatacacagagtagttttttttaatgtgatgtcctttccatactctagggctgtattagcagatcttgatgttctgaagcttgtttattgcatctggcctgcaaacaaaattaattgacacacatgctttattccagattgtggtgctattacatgtattgtcattattatgattttagccataagtgtttggtttgaggcagaagtagtgggatattgctgtcaagtaaactggggccactaaccttgtgggaatcaacttagcattttaaaattatagactcgaggtttttagaagaagctgaagggttctgtatgctgcatggaagattgagttcaaatcctacttctgacaccatatgatattatttttcccatctctgtaggatgggaatttcttacagttagtactacggtcatgcagatttctattttcccagggcctgacacagaatagatgctcagcagattatgacacatgtggcttcttttgctgtgagccagtcatgggatgaagacacattgcctatgcattattaattgattgctataaaacatgttgcctcaaaatataatagcttaaaacaacagacacttattttctcatgtagttcctgtgagtcaggaatccagacatagtttatctgggtggctttggcttaccatctgtagattgcagtcagtatgtcagccagggctgcagtcatttgaaaacttaatttaggctagaaggtccacttccaggatggctcattcacatggctaattggcaggaagcttaagtttcttactacatgggcctttccagagggcttctgagtgagtacatgacagtgtgtcactggcctcccccagagcaaggagagagcaggaaggaagatctaataccttttatggcctagtgtcggaagttgccccctcacaattccacttcatcttgtttgttaggagtgagtcacagtgtccagcccacactcaaggggaggggaattaggctatacctcttgaaaagcggagtaacaaacaatcttatagtcaagattgtgtttgtgtaaggttagaatagagggtccggaaatagacctataattatatgaccgctcgaaaacgccaagacaatttaatggggaaagggccatcttttaaaaaataatgctaggctattcacagtagcagaaacatggaatcaacctcaattttcattaatggtagactggattaaaaaaaagaatgtggcgcatgtacaccacggaatactgtgcagccataagaagaacgagattgtgtcctttgcaggaacatggatggaactagaggccattacccttagcaaacgtaacagaggaacagaaaaccaagtattgcatgttctcacttataagtgggagctaaatgatgagaacacatggacacatgtaggggaacagcagatacaggggccttttggagggtggagggtgagaggagggagaaaatcaggaaacataattagtgggtactaggcttaattcctgggtgatgaaataatctgtacaacaaacctccatgacacgagtttacctatataacaaacctgcacatatacccctgaacttaaaagttaaaaaaaaatggtgttagaacaacttgacgtctttattgattagaaaaaaatgaacactggcccttaactctgcaaaactgctagaaaataaataaataaataaataaataaataaataaataaataaataaataaggtggtggtggtgatatgcccttgtaatcccagccattccaagggctgtggcaggaggattgcttgagcccaggagttcgagaggagcctgcgtaacatcgtgatataagaaaatgagactctttccctgcctttccctgcaaaagagagagagagaaaatctgtgtagcccttgagtaggcaacgatatcttggggcacaaaacatacagaccctaaaagagaaaattgatgaagtggacttgatcaaaatttaaaacttttgctctttgaaagacaccattaagaaataaaaacaagaaaatgatggggagaaaatattcacagttcgtatagctaacaaaaaattggtaatccagaatgtataaagagctcttacaactaggtagtaagaagaccaagaaagatttgagcagatacttcaccaaagaaggtatatgagaggccaacaagcacaccaaaagatgcttgtcattaaacatcatttaatcatcagaaatatgtgaattgaaaccacagtgaggtaccactccacacgtgctagaatggctaaaattaaagactgatagcagatattggtgaaaatttgtagcaattggaatgctaatgaatttttgatggagatatacaatggtacaatttggcaatttcctgtaaagttaaacatacattttttatattacccagtaacttttctcctaagtatgtacccaagagaaatgaaaacatgtctatagaaatatttgtatatgaatgtttgtagcagataaataataaccaatgcctggaaacaactaaattgtccagcaggtgaatgggtaagttacagtatatccacacaatgtaacaccactcagcaataaaatggaaccaacaactgatatatccaacaatgtggatgaatgtcacaaatgttatgctgagagaaagacatcagacacaaaaagaataaatcctatatgatgttatttacatgaaatctagaaatctagacaaatctaatatacagcacgatcagatcagtgcttcctttgggcaaggggtggaagatggggaatgactgggaaggagcacgagggaaactttctgagatgatggacttgttctaaatctttattgtagtggggattgcacctgtgggtgtctttgaaatgtttattattacagttatttcttaatatttgtaggggattggttccaggaccaccccaccccctgtccctagtataccaaaatttgcagatgttcaagtttttttgtatataaaatggcacagtatttgcatataacctacacaatccttatatatactttaactcaccaccacattacttagattacctaatacagtgtaactatataaatagttgttatattgtggggggatttgtatttttttggttgtattgttattactatttttatttttccttgaatattttcagtctgcaaatggttgaatctatggtgctgaacctgtagatatggagggctgattgtattttattgtttagacattacaccttattaacattcatttaaaaacatctgttgaggtttggatttttcagaagttataacatctgatctttagagtcagtgttcaatactatccctttgttatcatttataggtcaggcttaatagtattatgtctagggagaaaaacgccaaactgtggcttctttccacagaataattggctctcatttccttatcctccccatattagtaacttgtcttgattgtagaagcaggctaatgggagctttgtctgggcttctttgtgaaagctttttttttcagtggcatgtgctattatgcctaccatgccatttgaatcctgtcattgtacttcttgaccagcttgtcaaggtaggcatacagaagatagctcatgactcctgttaactgactcatctcttatggttgcagattctcataaacacaaagataaacacaaagatcgagaacaccggcacaaagaacacaagaaggagaaggaccgggaaaagtccaagcatagcaacaggtaagggtggaatcaagcaagtccctcatcattcagcagtgggttggccattgcttggcttacctggaataggtcttaacttgagctacatgtaaagatagcaaagtaagtagaaactgtatttgatcctagagttgctatgaggatggccatgatttaggccttaaatgggatgccattgttcagatcaagatgtataaagcaagtatgtttaattttcttttaatatatacctcattaaaaatacagttgttcactaagataggtaaggattcattgtgacacatgatggcatttaatcaagtctgtagcaagcttgccttgataaaaggtaactggattggagacctgattttttttcttctttctatattttaaagagtttacattaaaaattcttaacttgggcttccatggtctgttagcccctgaaattatatgcaaatggttgagtatatgagatttcctggagagactatttgtagctttcatcatgttatcagaggagttcggctcccacaaaagcctacaatcaccaatatgaatgaaactcaatagtgctgccttttgggatgcaagcctcaagaagatgtttcttttgttcattttgctcccatttttttggtgtaggaggcaagtggttaaatctagttattgaaaatgaggacttgtacttccattctgatttaaagacagttgttggtgagaaagccatatggtattcccattcccatagtggcctgagctaggttagggaatgtaaagatctgtcacacattagaacaagtgtctccattgtagagttcttagaacttctttattaacttgtctgattgtctgtagacaagttaaagtgagaattgctttctaagtctgttctttttcgcgaatcattaaaataaccagatttaattttctctattggggacatttctttgggaatcatgtatcatgcctgtggccttttttccctatccctcacttatctcttatcacttgatcatctagtttccattttcattattctggtaaatttaatctcagtagttgaatctactctacatcttttctagtttatagttgtctagcttatgttaatatctaccgtacagcaaagaatattgccaaggataaagaagttcattgcataatgataaaagggacccattaggagaacatagcagttataaatgtttatccactaacgtcacagcctcaaaatacatgaagtaaatctgatagagctgcaaagagaaataaacattcataattatggtcagagattttactatctttctcaataatttttagtccaaatagaaaataattaaggatatggaagacttgaacagtatcaaccaacttgatctaatcgacatttataggtttttcccatccaacaatattagaattttctcttttctttctgtctacttttccgcttttaatttttttcaggttttattttagattcagtgggtacatataggcaactttgttacctgggtatatagctgtgatgctgaggtttgggtacaaatgatcctgtcacccaggtactgagcatagaacccaacaattagtttttcaacccttaccgccctctctgctctagtagtctccagtgtctattattgccatctttatgtccatgagcacccgatgtttagctcctgcttaaaaatgagaccatgtggtatttggtattctgttcttgccttaatttgctcaggataatagcctccagttgcatccatgttgctacaaaggacatgattcagttctttttttatgaccgtatagtattccgtggtagatatgtacaacattttctttatccaatccatcattgctgggtacctaggttgattccatgtcttccctattgagaacagagctgcagtgaacatgtgtgtacatgtgtctttttagtaaaatgatttgttttcttttggatacataccaagtaatgggattgctggatcagaaggtagttgtttttttaagttctttgagaaatctccaaactgctttccctagtggctggactaatttacattctcatcaacagtgtataagtgttcccttttttctgcagccttgtgagccatctgctggtttttgatttttaatagccattgtggctggtgtgagatgatatctcattgtggttttgatttgcatttctctgatgattagggacgtggagcattttttcatacatttgttggccatttgtatgtcatcttttgagaaatgtctgttcatgtcttttgcttgttttttaatggggttacttgttttttgcttgttgaatcatttaggttccttatagattctggatattatacctgttagacgcatagttagtgaatattttctcccattctgtaagttgtctgttaactctgttgatagtttaattagatcccatttgtcaatttttgcttttgctgcaattgcttttggcatctttgctatgaaatctttgctcgttcctatgtccagaatggtattgcctaggttgtcgtctagggtttttaacagttttaagttttacatttaagtatttgattcatcttgaattgatttttgtatgtggtgtaaggaaggggtccagtttcagttttctgcgtatggctagccagttatcctagcatcatttattgaatagggagtcttttccccattgcttattttggttgactttcttgaagattagattgctgtcggtgtgtggttttatttctgggttctctgttctgttccatttggtctatgtgtctgtttttgtaccattaccatgctgttagtgtttctgtaccattaccatgatgttagaatacattctttttaagtgcacacgaaatgtgccaaaatagctcatactttggaccccactctccttaaaccatcttctttggctttaatgcttccatgcctctccatctttctggccacctttttcacctctttctaatgcacagtcattccttaacagtttttggctgtcttttctctgctacctgttttgctgtttatccttatttcacattccatatttggtcttgtgaacttcttttcagttccttaaacatagcatgttttctgatgccgctaagcctttaaacatgctgttggttctgtaatactctcttgcccctttgctgtcattcttttagttgcagctcagacttgacttgttccaggtatcctttctaccctccttctcatattaaatgccacttttgtgtgctctctggtgccttgaatatattcctagtgtaataattattatatttaattgtgtctttacttttccctatggcctcctggactctaaagtccctgaaagcagaattgggatcttttttgttttttctggggtggggcggggggctggttttttgtttgtttgtttgtttgttttttgagacggagtcttactctgttgcccaggctggagtgcagtggtgccatctcagctcactgctatctccacctcccaggttcaagtgattctcctgcctctgcctcccaagtagctgggattaaggtgcgtgccccgacacccagctaattttttgtatttttagtagagacagggtttcaccatgttgactaggctggtctcaaactcctgacctcaagtgatctgcccaccttggcctcccaaagtgctaggattacaggtgtgagccaccacgcccagccttttgtattcattttgcatccttcaggcttagtatggtacctggcagatagctggcacttactagtctatatttattgaattaatgagtggatgatctatgggtacattaattcccatctctctttcttctcacgtactcttaatcttctataggatagttattaagtcactttggcttatctcatttttcacacaattgtgtgtggtaaaataaacataacaaaatttactgttttaaagtagcatttagtacattgacaatagtatgcaactgtcaccactatctccagaacttttcatcatcccagtctttgaattcactaaataataacttttcattctgttcccctgtcccaatatctttctactttgtctttttttctctttcccttctaccttttatctttatgaatttgcctattctaagtacttcatataagtggaataatacaatatttatcttttttaaatctgttctatattcccttaatatgttttcaaggtttatccgtattgtagcgtatcagaaattcattcttttttatgactgaattatattccattgtatgcctgtaatcacatttaaaaaaatccatctgttgatggacacttgggttgtttccaccctttggctacaaatacatgtttgagttccactttcattctccggggtgtatacctaggagtagaattgctagatcatgtccaacaatgggtggctgcctgctatgtttttactgtgctaattgatgtggtgtgaaaaaaaaaattagataacctttgaccgtgaacagtatcatctgaggaggtgagagacctgcttacagatcagatgaagaatgttgatttttatattactaggctgtaagaagaaattccaaaagactttaagaagaaagaggttaatatttaaaacataagcttttgaaaacttatcttctctaacacattctactttgttttgggaggaaagatacagtaaaagtgacataaagggctttgagacatataagtttggccctgtcctgttttacaaaaatcttctcttaaaaaaaaaaaagggatgtgatttttttagaagaaatcctcatccttgtacatccatttaagtctcgtgatcttggctaggttacttaaccttcttcaactcagtttcttcatcttcatcttgatacatgcttcacaggggaaccatgggagtcaataaatatagaagctcttcagttgtgaactgctctacagatgtgcagagatgacacttttacatctatttaaaagcatacttttccaagatcatattgtaggtaaattcaataatttgttgtatgtacttttgtgcctcttttcttttctttttttttttttttttgagacagtcttgctctgtcgcccaggctggagtgcagtgacacaatctcggctcactgcatcctccgcctcccgggttcatgccattctcctgcctcagcctcccgagtagctgggactacaggtgcccgccaccatgccccgctaattttttatatttttagtagagacggggttttactgtgttaaccaggatggtctcaatctcctgacctcgtgatccacctgcctcggcctcccaaagtcttgggattacaggcgtgagccaccgcgcctggccacttctgtgccttttaatattttcttcattcctataaaaatagaagcctttttgccaagagctattggaaaaacctggcccgagtttctgtttacatatgacatgactaaatctagcccttggtttcttattcacatgagtaaattttaacagtttaatcagatgatctgttgtaagcaaacttttaagtacttcttgttttgatgtctactgacacagtacctctttgcaacaaagcaaggatattggttatattccagtaaaattattttattattttttttgagatggagtctcactttgtcacccaggctggagtgcagtggtgtgatctcggctcactgcaacctctgcctcctgggttcaagcgattctcctgcctcagcctcccgagtagctgggacttacaggcgcctgccaccacgccgagctaatttttgtatttttggtagagacgaggtttcaccatattggccaggctggtctcgaactcctggccttgtgatcctcctgcctcagcctcccaaggtgctgggattacaggcttgagccaccacacccggcctccagtaaaattttatatacactgtgatccttttaaagtacctctgatctttttaaatagtttagggtttcttcgatttcttctgtagcagattaaagaaatctgggggattatttaatcacatctgaaccccagaataattagtatttagcatgttctgttccaaaatgctttcatttattccaatccttgctaatcaattgtagctaattttgtggccatttgttaggagaaaacaagtgtttcagatgtgtttctgtgtcccttccttctctgctagatattagcaccaatcatttgtcatcaggctatacttaggacccaagcccaggaggcatttactgtcctgtgcagtagcaatactgcagacttggagtgggagagtagccattatgtgcagaaacaaaatggggctatggatccacatcccagaagatgccatttggtttcctctttattgtcctcatgcaaggtgcaaaacaagggagtaggtattaagaatcatttcatcttgtcttctctttgtgtggacaggagtctgaggtcacatgctctaagtcccacagtgatgtggtagcagaaagaagaggatgtgagaccaaggatcctgagtccccactacattattccttccagtgaaaaatacctccctgtgtaaaaagagttagttttgtagctaaactgtctgtttaaatacaagcaccccttacttgtatgcatatggtaggcagctcaggtttaaaaatgtcagatcacctcaggcactgcctttatctctctttgtccccaaatccctgaaatctttggcactgaaagtattaatgtcatcaaattctgaacctatgaaaacttcatctctgtctttctcttgtctggcctgtaacatgacaagaacagctcacaccaaagttagaagataatttcatcagtcatcacttatctcttgacactgcttctttctgttagcgttaatattttgctcctcagatcctttttctttttttttggagtcagggtctcattgactgctaagcttgggcgcggtggtgtgattatagctcactgcagcctccctgggcccaaggggtcctcccacctcagcctcttgaatagctgggacaataggcatgcaccaccatgcttggttaattaacttttttgtttttaatagagatggcggtcttgctatgttgcccagggtggtctggaacttctgggctcccacattggcatcccatagtgttggggttacaggcatgagccaccatggccggccctcttttaaaaaatacataaataatctcaaaaggaatactcttctagatgccaaggaattacgtagcttgtaggatctcacgagctacctttcttaaagggttacattcttatccattgtttatctttaatagtagatctcttgtataaacagaatattattaaaagcaatttgggaggggggcttgattttagaaaataagagaatcgtgtgaaatgaaattcctcctagttttcgactctgtgcatctcttgccaattttaaacctggcattcacactggagtgacaaatttgtggaaagcaagggaagacagaaaactgctgtaaaatagcaagggaagtacttttccagccatattggcagtgctattctgtactgtcagtgtgagaaacatctgagaataaggatgcttttggcttctgctttccttttagttccaaatcctacctgaattgtaattgagagaatgtaggattttaggaatatgcacttgaattacgcatctagttctcagattaggggagatttttctgaaattaataaaatttaaaagatatgtttgctgctttccttgtgagtggtttgccaaagccctccctttgtctacacatcactatatcatcctgtctgtgggaaatggacaactaacatgggtaggcagagaagattgaacagtttggaaatgaggaaactcagtaccaccaccattcacatgggagtcagtatgatatattgaatagcacactaagataaaagttaagaggctgggttctgtcatttataagctacgtgtcgtgatccaaggtgcttaacttctctgggtctcattttctgttttggtcaagggttgataacagtacctgctttatcaatctttcaagtttgtttatgcacatgacagctctttgggaactgtaacatactaaataattgagataatgatggtgatgatgataattaccgcaaagcctagtataatatcatgcagataaattggagctcttgagtttggtagttgaatctaattcagtagttattgatagcattcaatttggagccctgatattttcaatattatatttatccctatcatagtacgccataatcattgtttttaagatttcatggtggagacagcatttgagctagccattcaaagatggttaaaattttgctaacggaaagtaatggttagaaagaaaaacataagcaaaatatagaggcattgtagtatatgctttgttctgggaggaatctagttaggtgggttacacagggtggaatagtagaaaatgagacccaaaaaagtggcttgaggcaaaactattaaatgccatttcaaaaagttggaacttgttacttacactaactaaaaatcggggggaaatgttgggactcgattctgagctgagcaagaagccactggaaatacttgagcaaagtggatataagacttagctacaaatgacatgaagggtctaagaaaaagggttcctgtcttggataactgggtggctgttcacgctattaatagagacaaagaacttaagggaggaatgggagttagaatgggtatcggttttgccatctttgggcacatccttttatcctctctggcctgaaaacaaaggattaaataatttctaggaaattacatttaccttgaagttttgatacttctataatataaaacgccggagtccttgtgattttgtttagagatatataatcggcattgtagtgtgtaatgatgatggacattaaggaacccttgtttcttagtgccttttggaaactggctcatttcagaagctgcgctcttttcccagaggcaacttttgaagttacttaaatatttaatttaacaaatatcatttaagatttaactgtctactatccttgaaagggtcatgagtttccctcctaaaccaagactttgaagctctctgtgctgtctcacaggaatccccatgatccaacttcatgtgacctgcagaggtctgctgccttgaggagtagacaggtagctgggctgttagtggctaagtccttttctcagaatatgtggaggctccttctacctttaacagtgcttttttgctttgtttgggaagtaacagagtagtcaagtgcatgaccctggagccagactgcctgagtttaaatcctgtttctctctttagaggtagttccttgggtgagttacttaacttgtctgtgcttcagtttccacatctgtgaaatgaagataccagtagttacctgagttttgttaccgatatcaaatgtgcttagatgagtgcttggcactgggtgctactcaagtatctgttaaatacttttatgggggatagaggacagatttaaatggtttcccatagccaacattctagctttccagaatatcagtattttgttgtggtagcggtggtcttttttcctaaagaaacagtgcttcgccagaagggagacattgttccctactggctccctacttccaccgtttctcccactcttctatataagtgccttagagaaactctggtcacccttttctgtggtctgcttagctccaacaagaatcatagaccaaaggttttgctgtcatcactttaaaaatagtgtaagttatttttttctttcctttttttaaatttttttttttttgagatggagcctcagtctatcgccaggctggagtgcagtggcgtgatctcggctcactgcagcctctgtctccctggttcaagtgattctcctgcctcagcctccccagtagctgggattacaggcatgtgccaccacgcccagctaatttttgtatttttagtagaaatggggtttcactgtgttgcccaggctggtctcgaactcctgacctcaggtgatctgcccgcctcggcctcctgaagtgctaggattacaggcatgagccaccacgcccagccagattattttttctttagtggaattcagccaattgaagcataacacatggcatgaacactctggaaaggtggctttggatctttccatttgttctctttagcgctgacttttgctttctagtccctgctagtgtgttggaatcttaccccatacagatgcaaactatgaaccaagaagtcagcatctatgcctagccaataattggttgttttctcgttcagagttcctcatgcccatggggtaaattcatatttcatccataagtgtgaccattgcagaagttctaggactgctactgtctgtatttttgtccttcagcatatcccagactaaacttactcttaaaatatgtttgtccaacctttggtttccttcctatggttgatattaagcctttcttctactcttagaagacaaaatggggagacaaaaaaggcaaccctgaaggtttttatcctttcagggtatctagcatttttctaatttagccctactgaagtttcttcagtaattaatcatctgtttttcagcctctaacctggctaatattatagcctacaattgtacttttaaagcccttttgtgactttgacatattgtgtctattgtgtatggaaaagtagcaggatcagtatgaagataatacagtatctcttaaaacaggcagccagcaaatgaactttctgcattggtcagaatttccatcatttcactgttaatgaggaaagtacagttctttagctaccatgaaagtcaaacatatcctaagccttttggaaaaagacatacatgttagaaaatctcaaatggatgagtcagcctgactgaccccacattgactccattttatatgctggccaaatcctgtttctgactttcctggcacagccctggacatgcttctgtatcataggacttgttccccagcgcctttgctacttccttcaggcacattcctaggaaagattggcagtggggtttgctctttgccagcactcctgccggtttgggggttatggatgccaggttgggctccaggcactctgctctccatttgtggaggcagggacggtaacagcacctgacaagtagggatgatcacattgtattcagaagcctggtggagctctataaacccaaatttctaacagtctccaatgtaatgccctgtaatagaagctgtccttaaccctcaatcatctgtattcagctagtataaaaatgcaaatctgctcttatgcctaaacagttaggagtagaggagacttggcttcctttggaaagtcaggatgatagcttcatcccattctggtttttgtgattaattgtgacctacaaaggggtttactactctagcaggaactttgaatttcctatatacatctctttctggttagcaggcagaggaaatatcgttgacttttggcttcctggcaaatgtctcatttgccttgtcatttgttgattccttttccctgatctctgtttggtgtgataatgtacagcaaagctgaaaaccgcagggctacatgtacacttgtaggtacctatgttgtgattgccaaaaggctcagaaagccagttttctagtgaaaatggctaacattctaagaaatgctttcactgagaaagagaacgggtcaggggaaggtggaacttaaaggaagatggagtgttcctgaattcagattcctgaattagccatttatagtttcatgggaagacaatgaaaaaaaaaaaaaagaaagaaagaaaagaaaagaaaagaaacaagcaaccccaaaggtttttatcctttcaggtatccaaacatctttattctagaaagtttctcctcgatggtaaaataaagctaggaccttatagcaagtctcagactcaccatggctgtttcttaacaccagtataccttaagcagtaggtatcaatttagtggaaatataagggtattgatatgtagtggaggctgctctgaacttggaggtggaaatactaagtttaaatcccagcttttcttttaacattgcaactttgagaagtcttttaaccattgtctcctgtttgtatcagcatgaggggatagataataaaacctgcctcacaggagtgttgtgagaattgagtgaaataatgtatgtgaaaataccaagtacaatgcttgcttagaaagtagaattttgttttgccatcccctcccccactatagttggcagggcagggggaggcagtatattcatccatcaatattatagatgcaattgttcccagatgttttgcttttaggcaaaaccttgtatagatgactgtataccctcttacagttgatgcttaataaaacaaaactaccatggttttataatggaatggtaagctcaaacattttgctggtagtataaaaaccaagtgcctgtgattacctatacattaactcctgaagaatcaattataatctcagcaaccttgctctttgaccattcattctaaagcttggcgaagttaatgagaacagataataggagtgctaatgcaattggaagacttttttttttttaaacaaagtaaggaagggatacatttttaaataaaacattgcattttggtaaaaaacacagattatgagaacacattgagttagaggaacatcatattgattccaagaacaaaaagcatggtggagaaattttgtaaccatgcaaatccagtgtgctctgttctcatgagttaaaaagaattttcctcctatagaaacttgttatttaaatgtgtgtcacatgtaaataacagtctaatgagagcaatatagagggagaaatatgtaagcaagggaaagtgggcattgttttgtttttttttttctccatctatttcaatacttgggtctttcctaacctatagtgtgtcctgtttctccctggctagatttcttaaagtttctgcctattcatcactcaagtacctatctcaagttgtagctacttttgtgtgcagggtgtaatagcagatgttctcctgatctagattttgttgctctgcctaactgcatgccatcatttgtttctccctttgtgatcttctactgtagtcaagtgtccctttagaacaaacttcatgggatggacatagcctaatgagctcattgctgatgaagtctttttttcctgtgcattggttagtgcagtaagcaaggctccttaactgcctgtcccagtgtactgaaaaataatagtgttctctcaccttaaactacaacttgtggtttttgcttattgcttctttagtctttgaccacatgcatgtttttacatagttgcagttattttattatattcctttttctgtcataaacactttccaaatgtgtttgtggtactcaaattatagcttagcagttaaataatttgatatattacagtttcccctcttgttaggtgtatccaattttggggtttgtttgttcgtttttgtttttttctgttgttgttgttgttgtttaagggaagcaccaaaataaacctctttttaaaattaattaattaatttttttgaggcagagtctcgctctttcgcccaggctggagtgcagtggcactatctcggctcactgcaagctccgcctcctgggttcatgccattctcctgcctcagcctcccgagtagctgggactacaggcgcctgccaccacgcccggctaattttttgtatttttagtagaaacggggtttcactgtgttagccgggatggtctcagtctcctgacctcgtgatccgcctgcctcggccttccaaagtgctgggattacaggcgtgagccaccgcgcccagcccaaaataaacatctttatatgtaatgttatttccctaagataaatttccaggagcttgatcccagggtaagaagctatgaacattttcatggctcttgccttataatgtcatattttgctttttaacctttaacaaagaacattcctatgcccttgctttcagatgggtcttttcttattgtgaggaaagggctaacgtaagtcccatctagaagtgactaacttgcctagttaaaactagaaggaaatatccactgtattgggctgtttactccataaaccctggcttggctacatgtgtggtatgtttcaagtctggcacaaagccaccaaacacatttttggtgagttggttttaacctgctcacatcagatatgaatgctgaagttggagctttcattattgtttttgtgctggtagaatgttgcagaaatacacagggctggctgtgtattcttagtcactttaaaaaaaatgtcctggtgtgtctagaatgatggtttctgttctttgcaaaaataaaaacatcaaacaagataaagtccgatgtagccaagaccctctacttgaaccttctgtcggtactgtttgtttaagtactgtaagtttccacggttcatgttatcttaggatatcttgtgaaacgaatccttgtggtccctactctgggctaacgctttgtgacttaactttttacagtgaacataaagattctgaaaagaaacacaaagagaaggagaagaccaaacacaaagatggaagctcagaaaagcataaagacaaacataaagacagagacaaggaaaaacgaaaagaggaaaaggtacagagttttctagtaggggaggaaggaacgtggatgcacttttgtttacctttgaaagcagatatcttaattgcatagtaagatcccttggtcttgaagtgaaaggtttcttgtcaggagaatttagagcaaactgtagtcttaaactataaaaactaagccttttaccaccatatgtttcacagtggcagatctgtccatatcattaccttttttactttatattgccaatgaatacattgagaatgcattagggaaaattaattgtttttgggagaaggcctaatgccttgatggtcttctgttcattaaaggttcttcccgagtgaaaatttagtgatgctggtgtcttttgtggcatttggttccagcataaccagtgcaagccttctaaaaatgactaggctcacccagctgagaatgaatagtactctgtatagttttaaaaagagattgtttttattttagctttgaaaaagtaatttttgtacttggtaaattcagatactatgaaataaggaatatggtgaagaagacatctcttcacccctgactcactgtctcccatccttctcagaggcaaccgctatactgattatgttttgtattcttccatagatactctgtatatctgtatgtgtgtgtgtatccctttgtgtgtatatatgaagatttttttgaaagataaattttctgacgaatctagaaagcaggaagtcaaaggggagggggtcatgagtatactttgcctaagtaatagaagacagggcatagactacttttttgtttgtttgttttttaaataaagatgggggtctcactgtgttggcggggctagtctcgaactcctggcctcaagcagtcctccaacctcatcttcccaaagtgttgggattacaggcatgagccatcacatctggcccagtttatatgttttgtttgtttggtttttgcttttgtttcctctctgcactgccaatggcaaattcttgagtagtggaatgtatttattggggaaaagagacctgccaccacttaaaagtaaaaagctgccatttttaagggaaacctttctcagtgagttggacagtttcacccagaagaattgttaaaaacgagttttggacacatttcaggacctttagttcatctgttcagttttggtaacataagagccagcttgtgatcatgatgtcccaggaactgatgctacatattctcaaaaagaggtttcttcaaatttagtcctttcaaggtactagttactgttgttttacttttcaggttcgagcctctggggatgcaaaaataaagaaggagaaggaaaatggcttctctaggtaagactttgctgctgcgtgggcttccctttctctgggtggacagcaggccagctgcctgtgttgtagtgttgtctgagttaacccaaaacccactgacctggccatcttgatggttcccagaagctcagcagtgagaagactcggtctaagccaacctgagcctttctacagtgccatatagtgagactgaccagcacattttccagaaggttatttcgaatagagaaggttgacaggagagatttttaaaaattgagatttgacttgcatatcacaaaatttgtattttaatggtatacagtgtaccattttttttttttttttttttttagtatattcacaaggtattgcagcctcttcactaattccagaacattttcatttctctaaaaagaaacttcatattcagtagcgattatggagttttctgaaaaatcacttagtctgatttcatcattagtaatattgggaggcttatatataaaagatcatttgacctacatgttagggatgagtgtagatttgggtagaattatgttatctcttttctagaaggagaggaaaatgcgcaaaatctagaggttacttcctatactgtttttacctttataattttgttttcctcagcctcaatttcctaaaataagcccagaggtcccctctagtttcgaaacaactagatgtttattgttacatattctcacttcactgaatgacagaaaggatttattagaaatggttgtaagtgtttgcattattgactgggacaaaacactttgagagttttgcttccttgaatctttgaactttcagtttcatttgttaaaatttttgacaattgtgcctggtactctggggtcctttagacaaggagaaaagcaggtgccctcttcaggcatgtttcataattgttctaggaatgcagaataatacaattcaggaagcattagagctgcaagctgccctaggaattttgatttctgagataaagtgactgaggaggcactgctgggctaatctctgccaagagactgccttggatttttattaaactgatatgaataaattttttggacttggtgcatagtcatgaattcattttcagactttttgggttagaagattaggaacacagccttctttgaggcagtggtctctatgttcactttgctggactccttgctggcttgtgtatatgtctttgtagagaatccagatgcttcactggaatacagttttcaggtaaattgttttaggacttcttccttcagacctaagtaacccttcccacagtttttgtcttcagtgtgacaaacttaggatctagcatttacttaactagttgggtaaatgataggctttctttccttctggaccctagggtctgtgtcagtattcaggcaggagggggaacagctgtagaagctggcatttggttagggtgctaaaataagttctttaaacattcaaattctatcacaagcaaggggacccagtatgctttttttggtcggaggtactcttgaaaccctgtgaatatactttgcagtggggtcgggattcttaatccttggatccctccacagggggcagctgcatgtaaggaggccatttcttgtactaagttaaggcagtgaggttctgaagagatgtgccaggccagggagcatcccatggctgcagtgattgctgggctctatggtgttttttacttgttccttctctgttttggttcaagatgtttgtctcaaaggattgtctttttatatttatattttgaaggtaagatcttaacaaatagtagtgagacactcttctgtatataaagtaaacctaagttaggacgttgaacaatgaatagatttggcataggataccttctgtttattctggtttaacacgtgccctacttttgttgtaatgttgtcagcttggttatttttccatgtagctagatatacatgtacgttattgccacatttttagaactttaaggtactaagttggggaaatcaatgtttattcctttccttgtaaaagctgtactttagcttttagagtactggaacaatcagttcagattgtggggtcaaatatatggtaggtttccatgtaaggcaagaaaacaccttaggtttatttctggagtggttcgtgccatgctggcaaagatagctaagaaatagtgagaaagaattctgacttagaataaagagtcttgatcccaaatcctgatattgcccattcacctgtacaatgaggacaaatactatctacttcacaggattgaagtgagaaaaagtgctcacagaacatcttcatgatatgtacgtggttatccttatttctgttagcttcttttcaacgaaatgacatattccttctttgtattaatagaatacagatgttctagcactctgaccagcaattttttttctctttagtccaccacaaattaaagatgaacctgaagatgatggctattttgttcctcctaaagaggatataaagccattaaagagacctcgagatgaggatgagtgagtattttcttaaaactttgacttttgaaaacaaaaaggaggagtttaaagaataaatgtgatgtgtttctttataatacatatagaaactgcattaattggcttttactcatttggaatttgtgattaatggactgatttctctgaactatgagaagtagagtttgctaaacaagtagtatacccaaggcttacatgaagattatataaatttttattactgaaaaggcaatagatatttattgtagaaatttcaaataatacagaattcatgaagaataaattatttaagttacttaaaatttcttattgcctaccacagataacttaaagcagtttctcttagacctattcctgtcagacattctaagtgaagtttcagtgtgtaaaaataataaaactgctcataaaacggtcgaggcttacatgtatctctttccccagattcaatgagattaaattatattcattattttcactcttatatagcttactatgctattgttatagtagaaattggatggaaagggagaagggaaatacttagtgaactcatttgtattcattcaatatagaatttctttcctccacattccagtgagttactgctatgtggtagctagtgtgctgtgtgtttggttcccaaactttcatcttttatttttatttattttattttattttttttcccagactttcatctgataatgatatttatttctgcatatatccccccaccctattttgcttccaggccggtgtaagtggtttgttttgttctatatagggctataactattactctttggtctgaccttcattattttctctatttctgttagtcttgaccgtagaatgcccagccaagaataacagtgattactcttgccatggaggcatccaagagtttgtaggtctcctatgagtgagaactcctgaatcataattatgttaactgtgtattcatgttcccctttctagtgctgattataaacctaagaaaattaaaacagaagataccaagaaggagaagaaaagaaaactagaagaagaagaggttagtaaagagacttaggtcctttggggcttgagtttggaagtgggagttttccagtaagcaacttcttaagacaaatgagttttagatatttattggcttgttataacattagggaaaacaaatttaataagtggtggctgtggcactggtagttttaagatctctgtgaatccccacagtgtcttaagttaaccacaaccagcagtgattctgctctcagccttcctgggtgtctgtctacccacagctaggctgccaacagatgttcttccaaaaactatgtcatcttcatatatacagaggcagtgttaacaagaaaccacattttggcttataaccctgaagaaatttccctaagaattttttgctgatcattcactttaggtaaccattcctatctaaagttctttaatgggtacccctttgacatataattgacacccaaactctttactgcagctcctcccaatctggcccctgcatcttgtgtctctcttcatcttgtgcctcttctctagcttacttgtaccagtcacactagcctcctttgtttcttttccacaccagattctttcaaacttccgagctttacgtagcacctgctgttcctctatctggaacacacatgctcccttctttatccttttggcctataaccttcctcaaaaaactcagttccgtttaaatgctttcctaaatgttcttgttgatgcttgtggtagattgaaaatagaatcatatgcttcctccttttgacacttttgagttcttgtaccaaaaaattgttagcaggtaattcaagaaaagatgtcagaaattcacaggggtcttaatgatgccctcccctaagacaagaaggggttgggtgagttcttagctcttatgctacatttgaggttagccactgtcatgggcaaaatgggatcacaaatgtaaagtggacagtttgaagtaccagcagtaaagagaatgatagtgaaggggcagggagtcttaagaggataatctatcataatagaatgatgttaataatcacaattaaatgtaataggtgcttaccatgtgccaggcactcttctatatatgtatcatttcatttaatccttacaacctgaataggttgttacatccctattatcatctccattttgcagatgcagaaatagagtatagaaatatttaatcatttgcctgaggtcacatagctactaaggtggaaaagccagcatttgatcccatgcagtctgacttcagtgccagcacaccagctactatattatcctacctcccctgggactttgctgatgctctaattctgcaaggagggagaagaaaggtctttaatgaaatcatatgaagaccattagtgagtgagttgagccatagagagatgatcaggtcctgaatttagaaggttgccgtttttttgacaactagtctattcttggccgaagttcaaattaataagcactaattcaaggaattgagagtgaaatgttaagtagtgattatggtagccaatcactccacttgcatataccaaatcagtacagactagtcagtaaaggaatataaaacttgagttctccaagtgttttttttttatgtttatattgcatttatgcaaaaataatactctgagtttgttaaaccattgggaaaaaagaacagttgacttcatttgttattattctatttagcagccctaccacatagggggaaaaatgctggctgaaagactgaattaatacaatcttactgtggcagggaccccagatggcagaatctgtcattaaacctcactcgccaactatagtttttttgttttttgtttttttctcttgtttttgagaattgttctgaggtctcttagtgactgacaccccaatttgaggcttgaaaacatacaatgtagccagtagtttcctgatgggaccagctggatgcctgctcagaagctgtttagagtatcttcactgaaaaacatttccctttcctgtggtgtgtttcaccctaaatagtaaacattatctgaattaatgtgatcctgtagtaccttctcccaaacatacccacatatttatattctccgtgcctgttttaaaatatggatggtactgtaagctttcctcttttttctattcctatcttgattgccatcctattatgaggatctaaaatgtttattccagttattcccataagtcacattctgttatttttctcataaagttaggctcttatcatagttaataacagctatatgaccttgatcaagtgacaaaatatgtttcaaagtccttgattgtaactggaagtggttaaatgaacccatccatacactttccagctgtgccactctttaattgattttaagatggttcaaaaccacctttcattgctatataaaacttgttgaataaagactgaataagtagttaaattatgttgaataggcaggacaaaggaaaatattcttcaaaagagttcagattctgagtgggatcttcacttgttgaatattacatttttgtttgggttttgtgtgtatgttttgagattcatctcctgtattggtgaattgtgcctgtttaggtttgatgcccgtttattgtgtcactgtgatcagctcatttacattcagagttcaaagaagagccataaagaaataccaccataggaattggtgtcattttagaacctatcaaatacttgcttactgcatcatgactttgtgtatacaagcagcagcgatagtactatactccactaaatcaactgggaattttctttcatcctgaatactaaatatctaatgcaaagccccgtctagccgttatttgattgtactggaagaggtttaaagatgagtaggattaaacataagtgaggaaaatacactcggattactctctagagcagtacttttccaaactcctttgaggttaaaaaaaaaaaagtttcccagtctcttcccctgcagagtgttttttaactactttctcaagtagttgtttgtcaggaaattttaggaaatactgctgtagaacagagcaccagtacattgttattcatctgtcaaatgagaggagtactaagatcttctttagttctaatactctatgattacaatttttcttcctcatggctcccaaaaactgcctccagaagtgtgatcagtctttatttaagtgctttctcaccatgtttctttgtaggatggtaaattgaaaaaacccaagaataaagataaagataaaaaagttcctgagccagataacaagaaaaagaagccgaagaaagaagaggaacagaagtggaaatggtaacatctcagcactgggttaaaatgccaccttttttattgcatatccttacgaagcaagagtattgagttattaaaattaatatcctgatatttggggggaaatactttaaacaatttctctagagtaactttctgaagtaagttttccaacttctagtgaaatcattaactggttctaaatctattggatctcaaactggtttccaccactgtgaacagaatggactgtagaagcagacctatgtataggtgggaatttagcatacgaagagagtacagatgcatttaaaaccatacggaaaggacagattattatgtaagtcgtgttgggaaaactgcctgttcaacaacagaagaaacctcaacaagaaaacgtgggtgaatatttttataattgtgcagtagtgaagatcctttgaagcaagacataaccagagccataaggaaaggtgttttacatttgatacatcaaagttcaatttatggcaggtggacaccttcatgccatttaaaaaaaaaaaaaaaactcaaggcaaaatatttgcaatacaaagggctgatattcctaatatgaaaaaaagctcttttaaaacaaatatgaaaggaatgatctaatcagaatgtgaggaacagtcagtttagtaaaatagttaataagcatctaaaaatgtgatcaacttcataagtaatcaaagatgcaaaaaaaatgataaatctttttgtttaatgcctctcagattgggaaagattaataagtgaaaatatctagagttgcaaatgtaagaaaacaggcattcgccttccctataggagtgaaaattcagtctttatgaaggacagtttagtcatagctggttgctcttgagaagtgtatttaggtggagaacttttctacttttgctgtttagaatcttgaaataaacatgtttttaaaaaatacttatttctgttaacatgttctatttaactactataccagcagtacatgattttgtgtttatgatgaaaaaactcaaatgattgacagatttaatagttagaataaaaatcaaagtcacctttacctgtcttctcccattctcattttcctttccagctttccagctttgaggtaatcactgttcataatttgatgtatagccttccaaacctgtttatgtgcctttatggcttttgtaatttagaactttgatgtccacagcacctctgaggaaagggagaaagagcactgaccaggaaggtggcagagggaaggagagccacagtggcagaaatgtggccacacggtgacagctatgtgattcgcatgttgctatggcatcatgggattaaatgggaagtatagaaaaggaatatcacagagcagagcaaccctgcctctttctagaggtcagagtcagaaagtaaaaggccaggcacagtggctcgtatctgtaatcccagcactttgggaggccgaggctggtggatcacctgaggtcaggagttcgagaccaacctggccaacatggcgaaacctcatctctgctaaaattacaaaaattagccgggcgtggtggtgcgcacctgtagtcccagctacttgggaagttgaggcaggagaattgcttgaacctgggaggcggaggttgcagtgagctgagatcacgccaccgcactccagcctgggcgacagagcgagactctgtctcaaaaaaaaaaaaaagaaaaaaaaccccacatgggtttattttcctcatttttatttcacttttcttaagaactaatacattttcagtgatcttgacctttaagaaaatgatttttagaaataaagtgattgtgtaaattagaggttattattgggagttaagagaatggtaggttagtaattcatcagtcagggttctgtggtagttactcaataaatgcttgttaaatgaacaaatacatttccttatcaggagctccctgctgtctcccctttacttcggagctttggctctttttgggatccaggcaagtgcgctgggtccagccttgtatgtgtagaattaggtgcccttgaggggtttaggagcctaattttgcttttgtggttgaaatccttatcagtgttgccacacattcactctgacagaccatgacttttggtttttattcttattttgggttaaaggggaactggctagtctttaactaaaagttgttttttgaggaatgagcagactttgctacagcttctaacgcatgcatttctcaggtgtgatggttaaaccttgcacattcttttcaagcacagtgcttgaatggcacaccgagtttttggtgttgaaaatatgaatgaagagcctcttaactgatagctagaggctgtgtatcatactctgaagtcagttatccagtcctcagtgactgccactgatgacctagtcggggagttaaatggcagatacccttatttttactattccttatgctatcctactaaaagaagtacacactttacaagcttgacaaatttgcagatctttttcttccctcgtaagtccgcagacctgtttgtctttaccagaaaaaaccacttactctgatctttatctccctcctttggtaattgttcagttggaaaaggtccaggtccctcagggtttctttgctatatcacgttatctccatagaaacattgttataagtggtggcagtgtgcttgggttcatacatgaaatcctgtttatcccagatgtcctgatttttaactgttggccattgtagctgaacagggtttcagcactgttgggttaattaagtacacttttgtgtcagggctgacctgggaatataagttgccagttaattctcaacagatgattcttcataaagaattacctggcgagtttattgcaggtgttaggtgtgactttaaatggagttttcaatctcttagcaaaggtaaaatgctgtgatgagtcaggactataatgttttaaggaattagtgttgcaagaccaagactcataaatatatggtcaatgatagtggtaagaaatttatggaatatggattattgacattttgctcaaaccagaaaaacttcccttaatttcaaggattagcattcagaagctacagcatctgacctttatttctaaatttaaaaaaattaaatatgagttttatagcatactgtgaagtgcttgttaactgcaagggaacttgatatcaaacagcacatggagtttactttcctgtctttatatttctagcacttttccacctttcccccttcaagcaaattttattattaaattggtacttgattattcaagtcaagctgccaaagggaagccatttcgatgtctaagtacatgtttttgtttgtttatttgtttttaaattgcggggggcggatatatgcactcatggggaggctaaaaggacagaactgtttgcttttatttgtataataatagctgtcagcccagtcacatgagcttactgaaacagatattctgtctttctgtttaaactgaagtttagtgttgtgatttgctgaatctcttaatttgcttaaatggtaaagaagttgctgtgggtcttcaggatacacatgttgaaataggagtcgtaaaaacagtttggagtcttgatttaaaaacactgtagggccgggcgtggtggctcacgcctgtaatcccagcactttggaaggccgaagcgggcagatcacgaggtcagtagatcgagaccatcctggctaacatggtgaaaccctgtctctgctaaaaatacaaaaacaaaattagctgggcgtggtggcgggcacctgtcgtccccaggtactcaggaggctgaggcgcgagaatggtgtgaaccctggaggtggagcttgcagtgagcggagatcacgcgactgcactccagcctgggcgacagagcgagactctgtctcaaaaaataaataaataaataaaaacactgtagtcgatgagaagaatggtgccaaagtcccaggataagggaaagggtggcgttcggaatctcctcacggttactctgtgactgctgcagacaggctccttgcagatgctctcatacacctacatatatatatattttctctatttggagagtaatagactgtaggattgggtggtttcctgcattgagatccttctattaatatatcaatgactctgccaatttcatacctgaaaaagtggtaggttagttatagaagatctttaatattcctttgaggtctaagattctgttaaatatttttgtttaaattgtgtaaaatacatatgacataacatttatcatcttaaccatttttaagtgtacaattcggtggcattaagtacattcatattgttgtgcaccatcaccatctccagaactctacatcttgcaaaactgaaactctgtagttattaacaattccccacttctctgttgccccagttcttttttttttttttttttttttgagacagagtctcgctctgtcgcccaggttggagtgcagtggtgtgatctcagttcactgcaaccttcgcctcctgggttcaagcaattctcctgcctcagcctcccaagtagctgggattacaggctcccaccaccattcccggctaattttttatatttttggtagagacggggtttcgccatgttggccaggctggtctcaaactccagacctcagatgatctgcccgccttggcctcccaaagtgctgggattacaggcgtgagccaccgtgcccagcctattcccccagttcttggtaagcaccattctactttctgtctctatgaatttgactactttaggtaccttgtattaatagtcatacagtatttgtcctttgtgactgactcatttcacttaacagaatgtcaacgctcgtccatattgtagcatgtttcagaattttctgacttttaaaggctaaataatattccattgtttgtcctgcattttgtttattcattcatcttttgatggacatgggttatttctgcctttggctgttgcagatagtgctgctgtgaaacattcgtgtacaagtatttgtttgaatattgagtatattcctgggaatggaattgctgggtcatgtggcatttctgtgcttaactttttgaggaactgccatactatcttttccacattggctgcacctttttacgttcctaccaggaccacacgagggtgctagcttccctacaccttcaccaacacttgttattttttgttttattgccatccttatgagtatgaatggtatctcattgtggttttgattggtattttcctaatgattattgatgttgcatatttttgcaggtgcttattggccacttgtatatcttctttagaaaaatgaccattcaagttctttgccccacccccacgtgtttttttttgtttttgagatggagtcttgctctgtcgcccaggctggagtgcagtggcgcaatcttggctcactgcaacatctgcctcccaggttcaagtgattctcatgcctcagcctcctgagtagctgagattacaggcgtgcaccaccacgcctggctaattttttgaatttttaatagatacagagttttgccatgttggccaggctggtctcgaactcctgacctcaagtgatccctccgcccgctttggcctcccaaagtattgggattacaggcgtgagccactgcgcccagcccctatttttaattttatcttttttttcccctccaccttaagactgagactttgcccatttttttaattgggttgtttattgagatgtaggagctgtttatatattttgtatgttaaccctttatcagatacatgatttacaaatattttctcctattctgtgagttgtctttcactctcttgaagtgtcctttgatgcacagaagtttttaagttcagtgaagttcagtttatttatttattgagacagagtgtctctctgttgcccaggctggagtgcagtcacgtgatctcggctcactgcaaccttcacctcccaggttcaaacgattcttgtgtctcagtctcctgagtagctgggattacaggcgtatgcccccatgcctggataatttttgtatttttagtagagacgggggggtctcgccatgttggccaggctggtctcgaactcttgtcctcaagtgatccgcccaccccagcctcccaaagtgcggagattacaggtgtgaggtactctgcccagctgcaattcatttattctttttgttacctgtgttttacgtgtcatatccaataaatcactgtcaaatccaatattgtgaagcttttcccctatgttgtcttctaagagttttatatttttgctcttatatttaggtctttgatccattttgaattaatttttgtgtataatgtaaagacccagtttgattattttgccaacactattgttgaaaaaactgttctttctccattgaatggtcttaagcatcttgttgtaaatcatttgaccatatatgttgactttggttttatagtaataccattgttacaatatggtttgatacatgtaatttttatttgatgtttctgaactttgtttaaaatattggacttgttccatggctgaatgattgataataaaataataaataaaatattgtacttggaaagtaaatatgagggtagtaagttagttatctattcgagtaaaagaaacttgaggcatagccagttgcaatttgtgagcctgagttggatcctggtctataaaataaatttagataaaatagggaagtttttaatatggactgggaattagaattatactaggagattattttgttagatgtgataatagttttgtggttatgtggaagaatattatttttatagagatacttgctgaaatatttagtggtgaagtatcaaatctgcaaccaactttgaaaatggttcggccaaaataggaaatgtagcaaattattaaccttttttttttttttttttttttgagatggagtctcactctgttgcccaggctggagtgcagtggcacaatcttggctcactgcaacctctgcctcctgggttcaagcaattctcgtgcctcagcctcctgagcagctgggactacaggtgcgcgccaccatgcccagctaatttttgtatttttagtagagacggagtttcaccacattgcccaggctcctgacctggatcacgacctcctgacctcgtgatctgcccgcctcggcctcccaaagtgctgggattacaggcgtatatggtgtttattgtattactcatttttttcttatgttcgaccattttaaaaatacattttcaaaaagttgttcccactgagctttagattcacttatcagtgtttgctagatagttccaggtaatgcgtaagtaccttaaactcaacatgccccagttaagctatcatttcctagtcgtcttcctttatgtcctttctcatagggttgttttctcctctaccttccatctgacgtcaccactctgaggaggccttttccttacaaacaatgtaaacaatccctctgtcatgtatgccattgtggtaaaacaactgtttacattttcaagtccctcacttgttactgagctccttcattgttgatctcttctgtccagtattcttaaactgagctgttgaaatgtattttcctttattcaccacagtatttcatcttacttgtgagcgttggctttttcaaaatgagagacactggttcttttgatccaggccttgaatgtgaggcccagaagtcattccagagcactaatcagttgagcggataattatttggcatttaatcagtgatgatccccatgttagacaaggcgatcactaaatgaggctgtgctttgtcttttaaaggtgggaagaagagcgctatcctgaaggcatcaagtggaaattcctagaacataaaggtccagtatttgccccaccatatgagcctcttccagagaatgtcaagttttattatgatggtgagttgtttcaaggttcttgattcttggccaggaaaagaaatctgcttctatttagggatagaaaacaaggaaggatcctatgtaatagataatcctttttatttcattttgttttattgccatgcaattttgaggaaggggcatcaggtgttaactcttaaaggctcatttgctgctgaaaaagtgccatggaaaaggggctattcatgtcttccctacatagtccaaaaaaggtttgtcaacatggctaacagtgtgtggtccacaagctgaaggttttgatctgaacttcatttctagggagcaactcttcgcaagagttattagaaaagcctcacttgaatggtagtattttatgttagcaatataacaatgcaatcggacaagctgctcatcactagaaacagtattagtatatggtcgaggattaatagtctgccatccatctctagatagggctggtaggcatctgtcacctattctgtgtagcataacactatgcctttgatatatgtgcaatcaagtctgatgagctgctttaaagaaatgccctgcctgggtctcttagaaccctcagaattgtcccttatctgtcgttggtatttgtatccttgggtttgaaggatttgagggtagcctttgacatgcctcctgttggcagtgtagcagtatgtagatggtaataactgattttcttcattccatgagttttatccagaaatggttagagcattgttcctcatacccttatgtgcttatgactcaccaaagtggatctgagcccatttaacagttgtggggtgggcttcttttccctttccccaccgtccctcttcttctttcccctttcccaaccatccttccctcttctgtcccctttcctgacagtcccccttctcctttccccagcattcctcttccacctccacttgtcttaccaccgtcttttggccactgttatttcaccaccccatttctccaccatttttcccaccctcagccccccactgttttcttctcacccatcccaccgcccgcactgaaaagaaaaagttctggggtgggattgagtacttctgaaccaagtggtctgctgaccaaactttgagaaacactgggcaggataactgctgaaaagcatcagtggtgaacactcaggcattctggtgcatctctcttcccaccagtagtggccttaggtccaccaatgcttgtaggcctaggtagtagtttacactaaagggctgggtctgcaactgaagaaagtgccaaacttggcaagctgaaatttgttttttaaaatgccatatttattagccaagtgtggtggtgcacgcctgtagtcccagctactcgggaggctaaggtgggaggattgcttgagtccaggaggcagagattgcagtgagcctagatcgtgccactcccctccagcctgtgtgacagagtgagaccctgtctcaaaaaataaaataataaataaataaataaaacatatttattgaatgtatttgtggtcagacaccaagacccagcagtggatagtactactgacttagaccctgatcttggggagtttgcagcctaacaggactccataatctcagaggcaaatgcttatgttatgtaaacattttgacctgttgaccagagagcctaagacagttctttcagccctcacgctggtcattcctggagactcttaactataactcaaagccaaaactcctaattaagagaaagggcctagaaccttgaagagcaccatctcaaagcgtaggtattccgtaggcctggtctggacttaccaagagctttaggatgctcagctggtaaagcctcactttgaggttcaaagtgatgggagggaaagctagattccctagtcctgtggtttctcttccttttcaagataggaagcagaggcctggtctagttcacaggttgccatagtcctttcctcccattcttgcccagtcctcctttacaggatcctgctttagggctccagcattttctcagctggtcctctgctgggatttcttctctttgattgtgtgaactcttactctgcagtaagtcaagaagtcatatttgactttacttcaaactgatacagtaagtgctgcctactctctggggaggagaattcttagactcctttagaacttgccagggaggtggggcatgggctagctgaagcagtgaattactgccttctctgaggaccttcagtttacagctttgattcagcagtttccttttcctggagctcagccttttccacaaagtgttaacattgccaggaaccttccagtcatcctcccactactctgatgcagggagccatcatttcatcttttgacagctcatctaaaataggaggagtcacagttgcttctccctctattaggacagaattcagtaaaacagcccaaaatctcattttttttaaatttatttttatatttatttatttgagacagagtcacactctgtcacccaggctggagtgcagtggcacaatcttggctcactgcagcctccacctccaaggttcaaacgattctcatgcctcagcctcccaagtagctgaaattaacaggcacgtgccaccacacctaagttttgtatttttaatagagacagggttttaccatgttggtcaagctggtctggaactcctgacctgaagtgatccttgcaccgcctcctaaagtgctgggattacagatgtgaaccaccatgctcagccacatttttttttaaatggtgttaacagtttacatttttttcttgccattttatttcatttattttattcctaatgacttaatgttttcctttatattggaaacatgttacagttttctaaagaagttcagggaatcttttaatacacagcctatcttccccgaagtgtctttcttccaaagcagaagcttgggggttgatgggggcagctgcgccacctgttggccttttaagttaatggcgtccaaagtgggttctttctattataactgtttcaatattgtgctacagttctctacacccctgcaaagtcagattgcatatcattatgagataagatgtcttctgagttttgaaataaatggatttctggttaaattttagttttctataaagaatgtgggcagccttggtgaattattaatacctgtgtaatagtaaggtggtggaattatagttaacctcattttaagtatagccaaatgctcttagtatagcatggattggttcgaggtgatgttgtaaagttggatttttaagaaagaatggaaattggcactaagagtactgtcaaaagcatttgtttgaaaagtggattaaattcccaagtacttttctttcattgctttattaactaaatcaggtatataaaacccataggccctattcagattttctttaccagttagcagctttcattgtgaaaacatctgagtccctttagacagctttttgtttatttgagacagtctcagtctgttgcccaggctgaagtgcagtggcgtgatcttggctcactgcaacccctgcctcctgggttcaagcgattctcatgcctcagcctcctgagtagctggagttacaggctcccaccaccacgcccggctaattttttatatttttagtagagatgggttttcgccatgttggccaggctgatctggaactcctgacctcaagtgatctgcctgcctcagcctcccaaagtgctgggattacaggcatgagccactgctcccagcccctttagacagcttttacataaacaattggatacaccaggaaccccagtcatcccttgtgctgtggatgcatcctggttccctgaaagaggcagcatcatggtacccatgttccagagcagtgtgtcgcaaactctagtgtgcatccaagtcttgttaaaaatgcaatttctgtataggattcagtaggtctaggagggggcctgggattctgcatttctaaactcccacatgatgccaatgctgctggtctgtgaaccacttgttgaatagcaaagttctagaagaaggtcttattaggcttttcatatgggaaatctgggcttgcctagtatggatatatatttttttattcatattccacccacctaactttgaagaagaaagatgcctatttcttttccccacaattcctttcttccactccctgccctatcccttcctccccttcttgaacagaggctgcttagcttagcagtggcaggagtccctctgaggatttgatttttaaaaaccattgaagaggtgtaaaggaccctgcttgctgaaaggaaaaggaagagtgactgggcctcccccaggtcatccctgtcctgagcaggcacctgggaacaattaactggcatagtctccagagaatgacccaggtaaatatatgctaaagagaaggagaatttgtacaagtagatataaatcagtatgttgtctttgttgttgttgctactatgtgtcaccagacctttatataccatgagaaggcaaaccattattaaagagaattcgctagccctgggtatttatgcttagaacatgaatactatacctcactttttggaaccacttttttctctaggtaaagtcatgaagctgagccccaaagcagaggaagtagctacgttctttgcaaaaatgctcgaccatgaatatactaccaaggaaatatttaggaaaaatttctttaaagactggagaaaggtactgtagcccatgtgttaatatcctagtaccttgcaaaacaatcaagtactaagtaataaattatcattttgcaaaacatttcctgatgtaaaatttgagttgtatggattttgttgtatttaaacttgcgtattttttgtcttcatttactatattatgtagggtttctgtccaacaagagtacttgtatatctttgctattggctctcatgtgatggcaggtaggtgggggttatcagattaggccaaacagaaaacctcaactccagttgcgcacaggaaagtttgtcgctgcaggactgccccgtgtctgctgttgcaaagagaaatgttaatctgatgtccctctcgctgttaattcttgctcatttattttaggtactttctactcttgaaaccacatatactatatttgcctaggtgattttttaaaatctcattattctcaatttggataatgtggacagaggcagcagtaaagtttacttcctgaactagctcagaaaaagcagacttaataaatgaatagaataggggtaatgtttccaagagagaatcagtatgggatttcaaacttgtattcataatgcctgggggctgtgtgccacggagtctaagaaaccacataagaattcatttttttccatgataagtcattttaaaacattttaatattagtaagtacatattttataataaagtaatacaactgtatttttttgttttttcaaaattcattaattgagattggctacttccagaaacctttgactgaaaaaatggtgcttgggtgtatttgcaaagaaacccaaggacttattagtgtattttcgttgtttttctttcatctccccattttcttttgactaggaaatgactaatgaagagaagaatattatcaccaacctaagcaaatgtgattttacccagatgagccagtatttcaaagcccagacggaagctcggaaacagatgagcaaggaagagaaactggtactacagaatttattaaacctctggagaattctggaattgtgattggttcatttaactttcttcttggttcttatgacacaacattaacatcagtaatttcacatcattctatgctaaagacttagagttctcaaagtctaaattttcttaaaggttttagttagactgaaaattgtgaacaagtactttgctcagtagctctgtacaggaatcttggtgcttcagtgacctaaaaaccagtcagtaactccagccaataatatagtaattaaggatgggcagacctgtcccacagtggctactggatattaaggatttaagacagatgaaatcatattggccatgtacctccctgctctttgatctattttactctggaatcttgtgatgctcatccatctccatcttccagccttggccatcctcattactgaaggatctttctggtatccagctgggatgtcatttttcttctacaggctgcctgtttttgtaaaaaaaaaaaaaaaaaatttattggaaccagctgcctctacttgtctacatattatctacggctgtgtttatgcaacaatgacagagatgagtagttgcaaaagagagtagttgcaaaagagactgtgtggcactcaagcctaaaatattttctatctagaaaaagttgtcagcccctgaactaaaggaatccaggctagaatttcatttttaccaatcggaagtccagaagttaaggattttaaggaattctttgcacttcaaattcctgtagtttcagtattttaaaggacttgcgtgtttacgtaattcagaccattgtattgatataactcattgtttcatggtacttatttggtcactagtttaaaaattaatgcattactataagaatgttaattgcatcagactttgtgtctcaggtaaatcttatcctcaatattccaagttagtgaaatttagtatattatttacttcaggggcattttgaaacttaaaagatcactttggagctttgttcttagaatattgatccaaagatagattttataaacatccccttgtcagagcctctgccaaggacacctgctgccagcaaggtctgaatctgttcccacccacaaggcagcacaacttagttaaactgaatcaataagtatataaaacgcagagtcaatagagggtaaggaggctcaaaatctcccccaccatccctcacctttttggagcaaggatcatagtatagagtgtatatacctgtatacctacaaaaaaattagtgacagatctgtctgagcttaaaaacccacgtttttaagctgtttaactgctgtttaattaaatggcttgagctattcttttatgaggctctatcagagactcttctccatttcctgttttgatagtactcagtaaaacagtatgaatttttaaagtacatttaaaaacacccaaataacatttacaaacatatatcctttaagacacaagaatcagttttgaatctagttgaaatcaatccttataggcagatctttttggggaattttatgatatttaagtttgagaaaaccactagaggttttcctttatttgaatttattttttagtgatttttcagactttcctctaccttgacttagtctcccacaagagataaaatgcattagtagagaacagcaatctgaatctattttgagtactttcttgctgtcttccagaaaatcaaagaggagaatgaaaaattactgaaagaatatggattctgtattatggataaccacaaagagaggattgctaacttcaagatagagcctcctggacttttccgtggccgcggcaaccaccccaagatgggcatgctgaagagacgaatcatgcccgaggatataatcatcaactgtagcaagtgagctcgcacttcatcctatgggccaaaaagggggtggagggcgtcctttattgtacttgggaatatttcccaggttacacaggactgtttgggaagggagatacttaagagcaggacagtatttcatgcgtaggtctccagatgtttttgaggtacagttgtctcccctcatccacaggggatatgttccaagacccccagtggatgcctgcaacttcgacccaattgctgtcacttggaacacatttctgttgatgtcttccacccccaaatttaatgtcttttccatgtttattaagtacttatcacatagagtggctataacttttgcagtctgaggcacaacagcaaaactagcacgactttctttttccttcttcacaatttcacagatggaaggttaattcttaccttagatcttagcaacttcaccatacagttttttttattaagtcgataatttccaccttttcatttaaagcactctgtgcagcttctgtatggcatatccaaattgccaacatcaccactttcacactttggggcctttattaagtaaaagaaggattacttgaacacaagcaatgtaaaaccattaaagtcaacctgataaataaggcagctactaggttacccatgggcaagtgacatatacagcatggtatgttgtatatatggttcacgcatcccaggtgggactacaagagatttcatcatgctcctcagaatgatgtgcaatttaaaacttacaaaatgtttatttctggaattttgtattgaatattttcggatgacagttggctgagggtaagtaaaaccatgcataaggtgggactactgtattgactgttaagaaggaaacttggaaaattatgctcagcagataggtccacttggggtcatgaaaggtgaaattattcctcacatcttatttcactatcctcgtgctctgttatttccagagatgccaaggttccttctcctcctccaggacataagtggaaagaagtccggcatgataacaaggttacttggctggtttcctggacagagaacatccaaggttccattaaatacatcatgcttaaccctagttcacgaatcaaggtaaggggatagttgagagctgcactggttcatggtgctgataacctttttttgttgaaatgtaacgttctcgtcctctagaatcactttgacaaattaaaaatcctccccattgaaagaaggcaagtactttcatagttagcattatggtgatcttcctacagtgcctccatttttttggtcacattgtaatcttatttattaattcacaaatatttactgaaatcccaaatgtgccccacacagtatacatttgatgctaggaattatgttggtaaacaagatagacgtaggccctgccttcatattgcttaacgtccagtggtcagaatgtgttgaagtatggtgattgtatattggcctctgcagatgtcttctacttcctcacctctcttggttatgagaagggaatgtagtttctgtatatcctgaaacaagttgtaaaatctaatgtcttacatacttctggcttcctgcagtctcatctgggtaggttcaccagggccaaatgaaatgtgtgtgaaagcacatcataaaactgtgttacatacctatgcactgttatttattgatagtgttattgcaaggagataactgccttgggggaaatcagtttttgtttgccagatagctatgtatatctagctttggagagtcccacgaacttcttccctccaacatactatgaaatataaacctaacagagacaaaaacacagtcaaggaattagttctatgtagactgttaactgttttatgtgcaggagacctgggactaaagaccttcttgatcctcgttcataggttataacatctgttaaaatgtgaaagccacagctgaaaaggctatgtgaataggcaagactaaactgtacattttctggcttgtagccctgtgttcttctgtatatcactacttttctaatgaaaaatacctgtttatatattttctccaattataaaatatacttttctggctgggtgtggtggctcaagcctgtaatcccagcactttgggaggccgagatgggcggatcacctgaggtcaggagttcgagaccagcctggacaacatggcgaaaccctgtctctactaaaaatacaaaaattagccaggcgtggtagtgggtgcctgtaatcccatctacttgggaggcggaggcaggagaatcgcttgaacctgggaggcagaggtcgcagtgagctgagatcacgccactgcactccagcctgggcaagagacttagactctgtctcaaataaataactaaatacataaataaaaataaaatgtagtttttgtagtttagataagtacaaaatcagaaagcgaacacttatgttgagcagactagtcatttaaagaaacatgtattcctcttctgaagtatcgcaaagctgtatatatggctacaaaagcagaaaaataatagttttagcccttaaggaacttataggctggtgggcaaatcaggtaagaattcagttgtattagaagaaagataaaagtaaaatgcattagataaacagaggagttatttgcagcaccttagagatcaacaataactttatgaagaaaagtaggttatggttgggtcttaaaagtagtatttcaaacaagagagaactgtgtcgtggacaaaggggagggtggtaagcagagtatgttgaggataggggttgagaaaaggtgtgataaaaagaattatcaagtggtgacagttgcacaacattgtggatatactactaaatgtcactagtggtaaatggtatcaatgcatattttaccacaacttaaaaatgatcaaaataacagagttactattaaaaacatttgcacataagttaacatttggatcttctaagcataccgcacatacatatactaatgccaccatttatagatgagtaaatttagtctctgggaggcccaaaaatttgcccaagattcagtggctagtaactctaacttagatcttcttagaatgtaacttagatcttcagtctctgcatgctttcctgtgacatccactgctaaatgtggccagctttaaatgccatgttaaagagactgagcccttaaaggactttgaacagtggagtgtcttgaacacagcttcacttcagcaagatttacaggcattatatgtaaatcacatcagtaaatatgaactgttataaatgctgcaaaggaaaaagtacagggtgccatctgagagtataccagggtacctgatccagcctctggggttcagggatggcctttctgaagaggtaacatttaaaggataatgtaaagaaaaaatttttttaaattagtacctgaagatctggctggcctcactatatagcttcctctcctgcctctttcttccctcagaacgaccaagctcttgctcacctctgggatttcaaaaggctactttattttctctattagaaacacccattctcctattctttccagggatacaatcctattcatcctgtaaatctcatcttaaatgttaactcttcagaaaggccatccctgaatcctagaggctggatcaggtaccccggtatactctcagatggcaccctgtacttttcctttgcagcatttacagcagtgtaaatctactggtgtgatttacatataatgcctgtaaatcttgctgaaatgaagctatgttcaagacaactccactgttcaaagtcctttaagggctcagtctctttaacatggcatttaaagctggccacatttagcagtggatgtcacaggagagcatgaggagcatacgctctaagaagattgaagagttactagctgttggatcttgggcaagttttagggcctttaagtttaaaaggaagccaccaacctgggatttaaagagggaaatgacaccagatttgtattttggaaactcgttacataattgatcattctgactgctgctctgcggagactggattggacacaaacaagaagtagagagatcaatgggaagctgttgcatactccaggcaagaaacagcgatgacttaagacaaatgatggcaatggggatggagagaggtgacagatacataatgtatgctgagtacttgtacaggtaaggattagagttaattaattgttggagcctctctgagggctgagatccttgttagatagaccaggtgaaatgcctcaagagcagagagccagtcaattttattccagacaatatccagctaactgctatacacaatagacatttgtgcaagtttctggatgatgatcatggtagtgaacctaaaagtcacccagagttagactctgaaccttatgctcaggagaaagtgcctgacttgaactgcaatgggatcccaataggagtcattaaaggcctggaaaagtggtgccattaggagaaaaagaaatgatttcttgagcttgctctcagttctcttttaggctgtcttgtactcagcagaatagtgagatcttcaaaggttggggtttgatagtgccttgaataatttttaactttatattgccagcggaagaagcattctctttttagatttaaaaaatgtagatacaaatattaggggttttatttttagtgaaacatttcaaacatacaggaatagataattatgtaatgaacactcgtatgtccaccatctggctttgtaaaatcttaaaattatgtcttatgtgctcaattgttttatttcataaaagatactgataaacatagctgaagtcacttgtataccattcaccttcttccctgtagattactatgaactcggtctttttattctcatacatattttttgtatttttgcagtatatttatgtgttcataaacaatatgtaattttacaatatgtaacacactagtaacatactaatttaaaacttgtttttagtttacaatatgttgtaaactattgtaagctaaagacatattgtacaacctattgtaaaataaaaacaggttttagttttaaattaggtatgttactgggatcattctgcaacttgtttattcctctccagctttgattttgtggttttattatcttaacctacacttttaattaatccattttatttgttacatggtattctattatatcataaaaacttatctattctgttggtttttgttgttggtcatttgagaccatgtcttcgctctgtcacccaggctggagtacagtggcgtgatcttggctcactgtgacctctgcctcccggattcaagtggttttggtgcctcagcctcctgagtagctgggattataggcgtgtgccaccatgcccagctaatttttgtatttttaatagagacgggatttcaccatgttggccaggctggtcttgaactgacctcaagtgatctgctcacctcagctgcacaaagtgctgggattacaggtgttagccaccataccctgcctctattctcttgttaagaggcatttagcatggttatacagtctcttgccctcataaacagtgctggaagaaacacatgtttcttgtgtatatgaatgaaaatttgttttatacattagatatttccaaattgttctcttaagtacttcagtttacatcattactctcctcctccctcccctcccacccccacccacaacagtattcctctttttccatatccttgctaatgtttctaaagttttgctttttacatttgggtcttagatccactagaatgtatttttgcattgggatgaagttgaaacctaatatattttccaaatgagtaaactgttgtcacagaactatttagttgtattacctcctctcttgtatatcagatatatctacatatatgtcagactgtttctgggctgtctgtcctctttaattagttcgtgtatctgtttctgcatcagtagcatactgtcttaactactgtagctttataaagtctattgagtaggacaagtttgtttcattcttcaaaattgctttggctattcttggccctctgctgtttcatattaactttcagataaacttgtcaaattctaatgaaaactgttgataaacttgttgattaacaaattctaataaaaactgttgagatttttattggaattgcaatacatttatagattaacggagaaagatattgacaatacaattgagtttccaattcacgaacatgttatacctctccattaattcatgtcttttgaatgtatccaccaatatggttttgtaattttcttcataaaggttttacatttaaaaaattcttatttttaagtgatcttatagtttttattgctaatgtgaatgagatttttttccattatgtttctgttggttattcctgaagtggtaatgcttataattttggggtgttggtcttgtatctggcagcagatacaagaggtgctcagagttgttcagggttgctgaactcttagttctaaaagtgtctgtcatttggggtttctatgtagataatttaattatctataaaaacagttcttcattttcagttcatatatttcatatttctttaagttttaatttttatttttaaacacaattatccataaaaccctaaccctttccctagtcaacagcagtcacagccaaatgttttattaattgctatactcagtgtttcttgtatctcataccttctggggtttcttgtcttgttgaaatacaccctttaatgtttctttagtgaagacccaacagtggcactcactcacctttgtttacctgaaaatttctttattttcatcttaattcatagtctgtcttttctccagtcaaggaagtgtcttatagggaagattctggtttcactatgctgtatccagggatatatatgtatttatagatagacttttaatctgaggactaatgtattttatcctacagtattaccaatcattatttcttccataacttctagaccattccttttgtacttcttttttagagtcctattagatgagtgttgacacttttcaatctagacatcttttttaaactatattttcatactctttgtctctttaggtctgattttttaagttcaggggaatatttcattttgggtgagttgtagcactcacttccaattcactaattctaattatatttaatctacaagttattccatctataatttatttcaattaccactttttgttttcaaaatttctaattttatatctgattttgtttcatttttgttttataatttcatgttctttctagattttacatctttttatgcatactaaacatactcacttgaaagtctttgtaagattgttctataaaatgttacctgaagtgaattcatgtgctaattactgttggcagtttttctgagccattttccttgtgtcttttgaaatttctgtttgtaagcccttttaactgggaggtgttttttgcttatgtactgttctcttttctttcccttcttctccttctctgttcattactttttgtcttggagggagtctcttagcccagctcagcccaagctaataaggcccctgacttcaagtccccccttcttgcatggagcaagaagtgatcctcctgtctcagcctcccaaagtgctgggtaggcgtgagccaccacatccagcctagagcacttacattgctacatatttggagcaaacataattaaagtatgacttactgtgacccagcagtcaataacagatatgtttttgtaatagaatgttgaagggtggtaactggtggttttacttcatggagggctttaggtcggctatatgggaagctgccatcatgatgcttttgttctacacatttctgctcagcctccagagatgtctcctattctaagagtcgtctttgtttactcttgtgtctatattttacttacttaattccctcacataatagtgtatcattgtatcccatctgtgctctatcaagaaatgtagcacaagcatgatgtgaactatgaattttcgacaatttaaaaaattaaaggaatcattcaggggtaaaaagcacaaagttgtagaacagctgaagtgtgttctttttatgtatcctgtctttgccccctttctggaaacttggattggcctacttgcagtcactgtcacagttacactacttctagcctcaaaggtcattgaaaggattgggatttttgagaaccacaataacacttgctctaggtactgaaaaggttgtcctgaactcattcatatctttttatgttcatcccagtttgtttttgcttttccccccaggattttgattacacagacatcttgcaagcatatttccattctttctctcccactctgtgcctggtgcccgtaggatctgaaatagcattggaatgacagctagccttctggaacctgcagtttcaaccaaagaaactctgattccagataacccaggagtttcttatcctgcataatctaggagtttacaaaaaggctgcttatgggtactcactgctaagtacaatccactgccaagtttggaagcattacctgctctcacaacccagggaaagtagcccttagtaaaattcaggttttttcaaaccagccttaaccttacaaacagaatttatcatcatgatttttctttcaaatgcagtacagcaaactttaggatcaatgttgacatcgtattgcgtttagtcctgttaaaatactctcagtgccaaatacacacttctgccttttttctctttagagtctagaattctgtggggttccaaaaatgtatgtgcttacaaccttttatatgtaaccacctagggattaaagggctaaatgtgaaggaaagtatctttacaatattcatcttgggaagctctcattttggtgagttctattagagaaaataagacacaagctcattaaaaatatatatatattctgagcctggcatcttggtataaaattcaaaacgttttaaatctatttattagtaagactaacatagacctaagtgtgaagactaaaatattaaagcttgtaggtgatatcatggttgaatatgaccttagagtagattccttaggacagaaaaacaccaacaagagaaacaattgactaaatggacttcattaaaattaaaaatttatgttcaacaaaagacactgctaaaataaatacagaatttacagactaaaagaaaatatttgcaacatgtttatctgaaagggcttatatccagactatacaaagaattcctgtagctccataataaaaaaacagacatcccatccgcataataaaaagagcaaaagacttgaacatatactatacaaaagaagatacaggaatggtcaataaataagcaaatgaaagagtgctcgacatcactaattatcagtggagtgaagatttaaccacagggagatacgaattccagttctaggtatttttacctcaagtgaaataaaaacatttatccatgaaaaaacttgtacaagaatgttcatagcagtgctctattcataagagtgcaaaactggaaacatcccagaatagataacacattatggtatagtcatagaatatactatatttatcagcagttaagaagggaactacttatgtattcaacaacatggatgaatcttaaaaacatggttaagggccaggtgcggttggtgcatgcctgtaatccaagcactctgggaggccaaggcgggtggatcacttcaggtcaggagttcgagaccagcctggccaacatggcgaaacaccgtctctacaaaaaaatacaaaaattagccgagggtggcgcacacctgtaatctcagctattcaggaggctgagacatgggaatcgcttgaacctgaggggtagaggttgcactgagccgagattgcatcactgtactccagcctggtgacagagcgagacgctgtctcagagggaaaaaaaaaagttaaaaaggcagacagaggagtctatattgtatgattctatttatataatctagactaggcaaaatttatccatgatgatagtaatcagattgaaggatcagtggttgcttggtggaaattgactgagaagggaaatagtcatgtaagaatactggcaaatgtcctcttccccattacaaacgtctgagaaagttactagaaaacagaatccaatttgccttctcacccccaactttgtaatcttgaatccagatcctgattccacccaaccactctgctgaatggatagcagctatattagagagacaatatagtgggcctactagttttaaaaagtcatccaaagaatgtcatctacaatcagttaaattagatttttacccattactgaagtgtgattgaattagggaaagaggagaggtggtcaaaggcagccttctccagtggattccttgtcttcttgagatggttttgtgagaccttgcctggaagacctaggtggatagtttattttctaaaagtagtcaagaaagcttgttcagggcattgaacactgcagggacaagcatacttcttggaggccagccatctcctgctggatctaagcggggtggcttctgcctccacctccatctcagcttatttgagagaatcctagatccttggtgcagaagcccagccagcctgtgaagaaaagttggtctggtagtatcctgtgaatgacgtgcgggttgggtttttctaaatctcgtttacctgactcctaccttacattccagtggtgtgactaaggaactgagcaaacgtaaccctaggggactttgagacaggctttggtagtccatgtgcactagagtgaggggaaagaggccactccagagttgggtactctactgttgaaggtgagccttttgtgtccaatttttccgtgcatgtgtaagaacagttgtcatggagatttactactgacttgtgcatgaggacagcttatatctcaccttttcttattcaccctgttaaatgtcaaaatgtactaagacttaggtattttttctgtgtcaccaactactaaatcacccacccatgatagcaggtagttactgaaactcttgtagccaaacaagtgcataacactggtacacatgatgtgagagtgcagatgactccttagcttaactgtgtaagcttttaatttctgagtacttttaggattgagaagtggaagacattcttgctctaggtatctcatgcttctgcacacccagaaggctggttgcgcccccaccccaccccccgcccccttttttttttttttgatagggtcatgctctgttgcccaggctgaaaggctggttatcttcaccacaggtcttatgtctcaaggaccacgggtccacgtcatagtcaggaaccaggcatgtgtgggcagaaatcactaccactttcctttgttgcgggtggggaaattaagagcagagattcttggattcttaaattccttctctatgtttatgtcatctagtctgttttatgctgttttatgtaattccctgcttctggatttcttgaatttttttccccttctcacttgtcataattggctcttgcttgtgagtctattttcattcagcttggtagcagaagtcttcttcactattgtttagattcagttttcacatggttttagtaacccttcattgggtttagaatcaacttttaacccttccaccaaaagctcttatttttttaaaggcttcccagaaacatagtttctctcaatctcatcaagaaatgcttttaaatgcagaagttagaaaatggtgaataattatggctgttcctggaagtcattgtgtccttagtaattacatgttgtagtctttggttctgcttctttgacagctccaccacactgtaatttaatggaattcacttagatttaatggaattcagtcctggtagaaaactgctattgggtcacagagttggcagcaaggctgtgaaattgatgtgggaatgggggtgattatgtgctttgtgttgacagaagttagtttttgggacatcccatgtgggtttttcccaggaacataaacattttagagaattagagctagaaactttcttctgggaaagccttagaagtcagttgtgcttggcagtgagatgggacaatgtgcattcttaacaggttaaatgtgccaaactctctcttcagtactattcttttttacgtttgcttaaggtcaagttcctgctcttttgttcaaagtcttgctttgtcacccatggtggagtgcagtggcgtgatcttggctcactgcaacctctgcctcctgcgttcaagcaattcttgtgtcttagcctccctattagctagctgggattataggcttgcgccaccttgcctggctatattcaaagtctgtctttactacactgtcccaaagtaatctacatttgggtttgggtctttacagggtgagaaggactggcagaaatacgagactgctcggcggctgaaaaaatgtgtggacaagatccggaaccagtatcgagaagactggaagtccaaagagatgaaagtccggcagagagctgtagccctgtacttcatcgacaaggtgagagcatcttcccatcggcattgtctagtgttgagcttaacaaagggagtttctgctctgccccaggccctgtgccacatactgtatatcacaactcaacatacatatatttgtatgtaaaactgaatcaaaagttgcacaaaacaatgcttagccttactgtgagcagtagattctgatctttttttaactctatttcattcctttagaaagttggttataacttataaaattgtttaaataaaccatgcaggtatcaccattatatagttttaaagaccacgctctagaggagatcaatttcttggtactcacgagaagaaaaaaaagttcatgtttttcccccagtcttgtattttaacataagttctgaattgtctcaaaattcacactagctttttgagtttgattgcccagagtagcagcactccctcatttgctgccttatttaattttttttttccttttctccatccctatttcagaggacagaatagaaagaaaaggagcatgaatatttaacatccctatagatttcatagtgagtgggggaggaagtaacactgcagaatccagagttcccaggccatgctgactgatgctgtggcttcaaacagaattgggaggcttctgttttggatgcctagaaattgcataagggtcaaaaggctgggcgcagtggctcacgcctgtaatcccagcactttgggaggccaaggcaggtggaacacgaggtcaagagaccatcctggccaatgtggtgaaaccccatctctactaaaaatacaaaaaaaaaaaaaaaaataaaaattggcgtggtggcgggcgcctgtagtcccagctacttcggaggctgaggcaggagaatggcatgaacccgggagacggagcttgcagtgagccaaaattgcgccattgcactctagcctggcgacagagcgagactgtctcaaaaaaaaaaaaaaaaaaaacacagaacgaaattgtgtaaggatcatgtctcttccattcatgctcatcttttctttctttcctgggcagcttgctctgagagcaggcaatgaaaaggaggaaggagaaacagcggacactgtgggctgctgctcacttcgtgtggagcacatcaatctacacccagagttggatggtcaggaatatgtggtagagtttgacttcctcgggaaggactccatcagatactataacaaggtccctgttgagaaacgagtaagttaatgtacctgtactgtctgacttgttttccattattcaacaagcatgggttgactgcttttttgtgtgctttgcactttgctgggcaccagcaaaagtgacttgagacaggcaacatggcacatgcctgtagacccagctattcagaaggctgagacaggaggatcactggagaccaaaagtttgaggctgtagtgtgctgtgatcacacctgtgaatagccactgtactccagcctgggcaaaatagtgagaccttgcctctcatattaaaataaataaaaataaatgacttgaaagaggggagaggtattatttgatatcttgtgtacctccttttagtcactgttccgccctgtgctaccttcctggtaaggagtggccttctcctatagcagtattcaatggagcatgctgtagaataggcccttagagcaaactcagcatatgatttaactatatcttagtatcccctggtcatgtggtacatttgtcacttttcatctttgctcagcctttctccaactcctgactgagtgaaaggttaatgttagtccccagatctctgagcccatcactgaagagggtactatagctctgtagtcccaacctaatcttttccatagtattgggcttgaaccagagacttacagtgtgcaggatcctaataatccagcccaccagcagtcctcttcttataaagacacctcttctcataaggacaccataatcagtaatcaggttttgctggctgtggaagtactctggacagattagataacagtatgtatcaatgtaaatttttgaagctgatactgtgtaaatgtaagggaatatctatttttagaacatacacactgaaatgtttaggaccatattataagtaagtacttataaatgtactttaggaccatattataagtaagtacttataaatgtactttaggaccatattataagtaagtgcttataaatggctcagaacaaacaattatgtatatatatctgtaaatatacacatggagagagtgagcatacatgcacactgtgcaaatgatgaatggggtaaaatgttaacagtgaatctcggtgacggatgtatgcgtgttccttgtgcctttttctttgcaagtttctttaagtttggggttatttctaaagttaggatttttttcaagagtaataattaggattcacttatatcttttaggtttttaagaacctacaactatttatggagaacaagcagcccgaggatgatctttttgatagactcaatgtgagtagatgaagcacacaatgttgaagggagtcccagccagagcctcacagtacctaaaggggagggttgctggcagatgacttgggctctccctttagcctggcctgctctgtggcatcccatacactctctcttcctccctctgagtccacggtgaatctgtagtcaagagaagacacatctgctgcagaacaactgctaaagcactcagggtggggggtagatgagccctaccttttatccttccctgctcctgcagagctttcccttcactgaatgcccagccacccctgctggagacccaaaacctgtccctgatatcttaatagggaaggaaaaatttgctttattggtttgttaagcccaccaacctgggccaggcttggtggcttacgcctgttatcccagcactttgagaggtcaagtagggcagatcccttgaggtcaggagtttgagaccagcctgggcaacatggcaaaaccattatccaggtgtggtagtccacacctgtagtcccagctgcttaggagcctcagaaggattgcatgagcccgggaggtggaggcagcagtgaaccgagattgtaccactgcactccaggctgggtgtcagagtgagaccctgtcatacacacacacaaagattgaaatacttcatagagaggcatcatgtaaccctgtattctggaattcttttcctctttccctaacttcccacttgtagggccataaacttgacaagattgtgactgcactggcataaattactcctagggctgccagaaggagcaggtagtatagctttgacctaaatctgttgctttgtctcctccagactggtattctgaataagcatcttcaggatctcatggagggcttgacagccaaggtattccgtacatacaatgcctccatcacgctacagcagcagctaaaagaactgacagcccgtaagtattgcttggccagatagggcccacacccctactaatggtatccggtgaccttgcttatctaaggcctagagtcagttctactttttttccctaccattgtggtcagacactttttccctttagacctctagtagcgagataatgctttgttgtataaacataggatcaatgctgtttcccccttcccaccccaacttcaagattaatttcatggaatgctgacagcttttcacctgctacaaaaatgcctgcatttgtgttttatacatatattacttaaaagcccacagagtgaagacagtgctgtgatgttctgttaaattggagagagtaaagttgtcatggttaccagaaaaatacaggaacaagtcctttccttgaggtttctgtcatttttttcccataagagagtagatactttctatagctgatttttagaatattatcaccaagatccacgggctttttttttcctggagcccagtcactattgaatttccactgccctctgtaaatacatcagatggccttagaatatgaaccagaaaagccagaggtaggtatgttgagggtcagtattttaaggtggtataaagaatgccacactatacaaataaaaacaatttttttggatggcatttttaatttttctttttaaataagatactaccaggccatgtgcagtggctcacacctgtaatcccaacacttgggtagccgaggcaggagaatcacttgaacccaggagttccagaccagcctgggcaatgtagtgagaccttgtctctactaaaatttctaaaaattaggcaggtgtggcggtgtgcacctgtcatcccagctacctgggaggctgagcccaggagtttagggctgtaatgagctacgaccataccaccgcactccagcttgggtgacagggtgagacgctatctctaaaataataataataaccataataatactaccaactgtggcttaatttttttttttttttttttttttttgagacggagtcttgctgtcacccaggttggagtgcagtggcgcgatctcggctcactgcaagctccgcctcctggggttcacgccattctcctgcctcagcctcccgagtagctgggactacaggtgcccgccatgtcgcccggctaattttttgtatttttagtagagacagggttcaccgtgttagccaggatggtctcgatctcctgaccttgtgatccgcccgcctcggcctcccaaagtgctgggattacaggtgtgagccaccgcgcccggccaaaatttttaaacttttaacgtcccttcaattcctcgttctgttctggctacattgggtggagaggtggggaggtaggaagtggccagtatagaacttatgaatatgggcaacaaaccatagtaatatcagcagcacctatgatgagcatatgggtggggaggaagcaaggagatgaagggtccctagccaagttccctgagtaaaaagaaaggtgtagattttattatattacctagactcagagttcctcttgtgataggaatttacccaggccaagcttacatataaacttcctactatcattttcttaagactgttgactcaaattttgaccttagtccttgggggcaatttgaattaatcatctgagtaagataagagccagcaaaatcatggggacgaggcactgggggaagacatactgtgtgttcacttttggtgtacaaactgaccctcttgctaccatgttcctttctttacagcggatgagaacatcccagcgaagatcctttcttataaccgtgccaatcgagctgttgcaattctttgtaaccatcagagggcaccaccaaaaacttttgagaagtctatgatgaacttgcaaactaaggtatcttggataaaatgaagggaactgtgtctgctgtgggcagattatctgcgaatgagaggattcagggctgagatatcagcaggccagtgctgggtctgttgtagaaggtctatgctaaagataaacaaatggaaatatgatagtagttaatctctgatcaagatactgaatatcagagtatccattattcaagaaatctttattctacgcatagaagttctatactggccactccctattttgaaaaactaactttggtgtacattctaattgctaattactgtccttattgtacatgaggaaagtggatttaaagagagtcttcataattccttgctacagcccagaaatacagccatttccaaattagattgtttcaaattgaaaagatgatgaaacaattatatatttaaagtctttcaaatcctagcatagctatttttatttttacgcattccacatgaatcatatttttatatagttcatcatcaaacatctgttgaatactggccgtgtgccagacaacttgctgccctaaagggaaagactggtgtgcaaataggtgctattccttgtccctgagcctctttcctcctcctaactccgcctggtactgagcttttaaaccataaggcacttaacatttgatgatgaacatttttgtgttagcagtgacttcataactaattcatcctaacatggtggtccacagtgagaatttgcagatatttcattatagaacagatacacagggttaaaaaggaaacaaattatattgaaatacagttatcaaaatacattttaaagtccgataatagatgtgcttccttattaaggtcttgaggtggcctgtagtaaatttcaaggtagtaattaattaatatcaatgatactttaagatttctgcagcaattcaaatatgaaatgaagatgtctaacatctattgatgataaagtcataagtgctgctgctattactatggtttgttccccatattcataactgaagaagaaatactaaatttcagctagaagctgggtgcagtggctcacacctgtaatctcagcattttgggaggttgaggtgggagaatcacttgagctgagtaattcaagaccaacctgggcaacatagtgagaccctgtctgtattaaaaatttaaaaataaatataaataagttccaaaaagaggttattgaaattatagattttttctcatccaagttcatggaattctatacttgtacaactggagtttaagaactactactgtggaatgagactgcattttaaggcccagaatattttccatttgttgagatttccttaagataagtacccatgagtaatatagctggttcaaaaggtacacacaacttataatttatgctacagatgccatctggctttcttgaagagacgtacatgtccacagtgaatgagtatacatccatagacctttgattccttggatcatatgattggcaggcaaagaactctatagacggcccatcctagcagctcacatttgctgccactctgttaaatgctggtcatctggaattgtttattctcctcatgttatcattacaagccagaaataaaagcatgaatattcaggtgctgtttacctaattcaggaaaacccctcccaggagcatgaggaggtcttttgttgctctcgctctggaaccgggtttgggcagcccaggctgcctgccagatgagccctccaaacccaggattcctctcctgtgtgcccacaaagcaaacacacgcccctgtttgccaagtgaatcaatggagtctttgatgctttgagagaatttgacatagcctgccaatttagcattcacagaaatggttaaaagatcatggtttgctacatttctatcctaaaaagaatctggctagtggtgtctgtgatgcttttgtatatagaatcagtcccctcagtttggctttggacaacatagatgttggaagtaagccattcatagtaaaacatatttagtgatcctctcacaatggtggcctctgtttccaatcttgggctgtgtgtatctaacaacaaacaattccaggttcagtgagcagcccagtgtgtgtcagacatgttatttactccgtagaggttgtcttcacctcacatagatgaccataggtatggggttctcctgccctctgagtagcgtgagctcagtgacaggggctctagctccatgttgttatccactgctgtctctaagcaggaatctgagaagaacttagattcaccaggggtgcttcaaagattctaacaagcaagaaaggctgaaactgcccttgtctcttcccttatagatatggattccatgagagttcacatggggaaaaaagctccacagctaaaagtgttttcacatccattgagtgacaactaaggtccttcccacctcagacttctctcctttttttttgagacggagtctcgctctgttgcccaggctggagtgcaggggcatgatctcggctcactgcaagctctgcctcccgggttcatgccattctactgcctcagcctcccgagtagctgggactacaggcacccaccaccacgcctggctaattttttgtatttttagtagagacggggtttcaccgtgttagccaggatggtcttgatctcctgaccttgtgatccgccctcctcagcctccccaaagtgctgggattacaggcgtgagacaccgcgcctggtgaccgctctccttttaaaaacagaatgccaaagctaagccctgccatgtcctggtttgggacagactggctgagctgtttggcttcctgggtgtcttttaattgccagtttgtagccccttgagtactctcttcagtgcatccattttccttgagaagctggcaccgccttcccagagtactggtgggatctgaggaacgagctggggttgcccagtagatgcaagtatcctgcttcagtttcctaaagaggagctcctacagtgttcttagaatgaaagctaagaactggcacaggatctatttgataaacagctgtcatttgtagccatcctcccagatgtatgacagcagagtgttctctgatggaaagatcagcacccagattcccagccccagcgggttcctttccctgagcccctaggttactgccctgtaaaacccttgtttctttccagatcactgaagaacaaatagttgaattcactagtccttgtgcatcttctccctgccttcatgaagccacccttgtttttttttatctgacaaaccactgacagagacagcctggtccagataacatcttggtttcaccttctcaggtggagccatttttcctctacagctcataaccttaccactattatttcccctagattgatgccaagaaggaacagctagcagatgcccggagagacctgaaaagtgctaaggctgatgccaaggtcatgaaggatgcaaagacgaagaagtatgtacctggtattgtgaaagttggggctggtagagaaaagtgtgcagcatctgtcagggcccctggggccctggcttttcgatggtttctgagaaatgtcttttggaaatctctatactagggcttttattgactcaaagtggcaggatgggtacagtgtgctcttgtctagagcccaggcctggttcttgaggactttgctattcttctagggtagtagagtcaaagaagaaggctgttcagagactggaggaacagttgatgaagctggaagttcaagccacagaccgagaggaaaataaacagattgccctgggaacctccaaactcaattatctggaccctaggatcacagtggcttggtaagtgttgagccctccttgagctcctgctgctagcttaagaaaggtggagggggttccgagagcactggtggccttcacatgccattcctaagctacacactttagtcctctggggaaacttctggcttcagctgtgtacaagttactctggttgctgaaccttgtctgtaaatgcattgcaacattctggttgctcctaaatggtcagtgctgttacactgccttgtagtgtatatttttaagaggcaggtgccatccctattcctaatggaactttaggacaggaatggaaactcttagcttctggaagaataggaaagagcccatccatctctacacttcaacaaaacttttcgttgaatttttttgcagttgaaggtaggaacaagagataaagatgagaatacagatctgagcaacttacacagagaggcagagggacctttaacaaaagcagataaatactaggtttctctgtgtgtcacacacagtgtcacataacatctgaaacaagtggctttgttatggaagatgtttagtttgagctgttaagttctgagcataggtggagatatcctcccctatggcacttgctagtccgggctaaagtttccatctaggtcttttgtacctctttctgctcgttttgccttgtttggtgctagagatttggttagctcttaaaaggcaatatagtatagtggttaagaacatggagaaaaactgcttgggttcaaatttcaggtcacttaccagctagctgtgtgagaaaatcagtaaattacctaacgtctctgcctcagtttcatctgtacgtttttcacttgtacatctgcagaagcacctactttagagatcactgccaagattaaatgagttgatcacataaaacctttagaacatgcttggtgcactattaatttgcatcctcactagacagatgtgaaagagaagatggaacatctgaccctgggcctcagatatgggccattgctgagtcaccctaatcccccccttatttctcctttgtttgcaggtgcaagaagtggggtgtcccaattgagaagatttacaacaaaacccagcgggagaagtttgcctgggccattgacatggctgatgaagactatgagttttagccagtctcaagaggcagagttctgtgaagaggaacagtgtggtttgggaaagatggataaactgagcctcacttgccctcgtgcctgggggagagaggcagcaagtcttaacaaaccaacatctttgcgaaaagataaacctggagatattataagggagagctgagccagttgtcctatggacaacttatttaaaaatatttcagatatcaaaattctagctgtatgatttgttttgaattttgtttttattttcaagagggcaagtggatgggaatttgtcagcgttctaccaggcaaattcactgtttcactgaaatgtttggattctcttagctactgtatgcaaagtccgattatattggtgcgtttttacagttagggttttgcaataacttctatattttaatagaaataaattcctaaactcccttccctctctcccatttcaggaatttaaaattaagtagaacaaaaaacccagcgcacctgttagagtcgtcactctctattgtcatggggatcaattttcattaaacttgaagcagtcgtggctttggcagtgttttggttcagacacctgttcacagaaaaagcatgatgggaaaatatttcctgacttgagtgttcctttttaaatgtgaatttttatttctttttaattattttaaaatatttaaacctttttcttgatcttaaagatcgtgtagattggggttggggagggatgaagggcgagtgaatctaaggataatgaaataatcagtgactgaaaccattttcccatcatcctttgttctgagcattcgctgtaccctttaagatatccatctttttctttttaaccctaatctttcacttgaaagattttattgtataaaaagtttcacaggtcaataaacttagaggaaaatgagtatttggtccaaaaaaaggaaaaataatcaagattttagggcttttattttttcttttgtaattgtgtaaaaaatggaaaaaaacataaaaagcagaattttaatgtgaagacattttttgctataatcattagttttagaggcattgttagtttagtgtgtgtgcagagtccatttcccacatctttcctcaagtatcttctatttttatcatgaattcccttttaatcaactgtaggttatttaaaataaattcctacaacttaatggaaacttaagtgtctgcctctttgttacaaagggcctcaggccagagttggggctgggacttagtgtgggatgaggtctcaccactcaggtcagcaagagtagattcctcccaggagcagatgaggcagggcctggcctggaaaggagtgttgtgtgcctgtcctgctgctgtgggtgtgggttaaagaggatccaaagtccatatccttagataaaagacaggaaaggaaggaagggtgcaaaaaatccacagtaagaggtgtggtgcaaagacagcatcggaggcctagcgtaggtaaagtatattgagcaggatgttgcagctgtatttgagtcaaaagttttggagagctttccatgtgtactggccagaagcagaagggagctgctttaggttttttcacgtggctaagcttacaatcaggatggggagaattaaggttccagatcccagaagccccttcccacatgggatgcaaacttctccctgcattgactgcttaattgaaaaaggcagtgtggtgtggtctctgaccactttctggtgctccagttaccctagctggctatggtctctacaaaaattgttcctttgctcatcctaaattataggtaagtctggaattcagaatgaaagtgaggtctctgtctaggtcaaatggactgcagggagcaggaaggccagaagggtcaaaattggtaaattaatggaagggccctgggccctctagcttgttagcacgagcaggtaggtgtcttcggggaggcgaacccatagtctctgttctccctgaggctggaggcagggctggtactaggcccacaacagagaatcctggaggtccttggcagcctgtatttttattaaccagtgaaagaggcagcattcaccccagggaataagggaggttatgtagccatcactgctttggagcagagagactccagccaggtgtttttgaattctgtgttgaggtagctgggccactgaatgtagggaatacaacagagaggctcttttggtacccatttgatacactgtggctggtaggtaagtaggttggtgtaagtggacctcagatgccacagctaggggacaacctttggtccaaaactagaagtcaggtaaggaggccttgcaggcagaagaccttgctgatgaacaggaagtaatgcctacctctctggcaaggacctctcttgcaagtctgagggcagatgctgggcaacaagatgctgctcaacacaactaagaagggcatcccagacagtggcagcaggcctgggagaccaaagccagagaatgggaagctgacctggccactggggatgaaagaagaggctgaacaggtaagtgggggccagatgtaaaggaccttgaaggatgcttaacccaggagtcaagaataaacttatccacttgcctagtccagtaggttttacttccagccacgtccaagaacaggccagatgggcagggtctgagaaactccctcccatcaggcctttctatgatgcccgagttcggtgtgggcaaagggcttccacgtgctacccaagccagatatctctgtgctgacttggcttttctcctctcttacctcaccttcatctcccatcccccaaatctggccagcaagtcctgtctctccattctccctgccaaaagctgtcaaatttcagacctctgctacattaaaacatgaaaagtaaaaaaccttcacaaccctcagccctttccagccactacctttcccttttttcccaaacaagcacctgcaataagtcatcaccatccagtcattcccccacccactgcaactagcttctgtcccatgagcccacaattccttctcttcactctgaccaatgtcgccaatgactagataaccaaaccaatacatgggctctccattctgcgtcttagagtctttgtggcactggacactgttgaccactccttccatcattttgagggtacgatgatttttagcaactttgctgagtggtgcaactattaaccatgtcagttttagaacattttcatctccctgtaagatcccttatgctcatttacagttaatccacattcccactcccggcctccactaacctttctaaatttgcattctgaacatttcatgtaaatggaatcattcaataggtgaccactaccttctctctgattttcacaatgccaccctctcctggttttactcctgtccctatcaggctttttctgagtcaccttttctatcaggtcctaagtgccatgattcttacttcagcatagctgatttcatttgcacctaaaggtgatgacttctctttctctctagcctagagcccttttctaagctccagactcacattatcaactacacctctgcagggcatgtctacgggcacctcaatctcagcgtctctagaactgagctcagtacccaccaccccaagcctgttgggcctgggcttcacatctcagggaaaggcaccagatcctctgtcccccaacccagaaactagggtagccaccatccttcactcctctcgtttccacacccagtaaattactccaaaatcatctcctcaataccataaaatttattttctgaaaaaattttactccttagaaattcttcaaataatgagacactatcaacttgttttgaaccaaaaagcactttttagagaaaacacattaccctgaaatgacctcagtcaggccagttttggatgcttataagtagtcccctgacaaaaatcagtaaacaaggagacaaagaaatttaacacagacttagtaattttcacaatcccaagaattccattcagacaagcctcttagaaatcactaaatagcaaagacttttttagattttataattgtactgtgtgtgtgtgtgtgtgtgtgtgtgtgtgtgtgtgtatacacacacaattttttttttttttttttgagacggagtctagctctgtcacccaggctggagtgcagtggcgaaatcctggctcactgcaacctctgccgcctgggttcaaaccattctcctgtctcagcctcctgccaccacgcccagctaatttttgtatttttcgtagagatggggtttcaccatgttggccaggctggtctcgaactcctgacctcatgatcttcccgcctcagcctcccaaagtgctgggattacaggcgtgagccaccgtgtctggcccacacaaatgtttttaaaggagtcttttaggccaggagcagttagctcatgcctgtaatcccagcagtttgggagaccaaggcagaaagatcacttgagcctcggagcccaaggctgcagtgagctatgactgtaactgcattccagcttaggtgacagtgagattctatctatacacacacacaccacacagtcttttagaaaaattgagatagtaatggataataagagttgaggtttgggtcaaaataatatgggaggggttagtgggtagaatttggcatgaaacaaaagtggccaccaattcattattgaagctagatgatgggtatgtcggcattcactatactatacacgtagacacatttgagatttttctttttttttaattttattattattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccagtttcatccatgtccctacaaaggacatgaactcatcattttttatggctgcatagtattccatggtgtatatgtgccacattttcttaatccagtctatcattgttggacatttggcttggttccaagtctttgctattgtgaatagtgccacaataaacaaacgtgtgcatgtgtctttatagcagcatgatttatagtcctttgggtatatacccagtaatgggatggctgggtcaaatggtatttctagctctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttacatttctccgatggtcagtgatggtgagcattttttcatgtgttttttggctgcataaatgtcttcttttgagaagtgtctgttcatgtcctttgcccactttttgatggggttgtttgtttttttcttgtaaatttgtttaagtgctttgtagattctggatattagccctttgtcagatgagtaggttgtgaaaattgtctcccattttgtaggttgcctgttcactctgatggtagtttcttttgctgtgcagaagctctttagtttaattagatcccatttgtcagttgtggcttttgttgccattgcttttggtgttttagacatgaagtcctgcccatgcctatgtcctgaatggtaatgcctaggacctcttcaaggagaactacaaaccactgctcaatgaaataaaagaggatacaaacaaatggaagaacattccatgctcatgggtaggaagaatcaatatcatgaaaatggccatactgcccaaggtaatttatagattcaacgccatccccatcaagctaccaatgactttcttcacagaattggaaaaaactactttaaagttcatatggaaccaaaaaagagcccgcatcgccaagtcaatcctaagccaaaagaacaaagctggatgcatcacgctacctgacttcaaactatactacaaggctacagtaaccaaaacagcatggtactggtaccaaaacagagatgtagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccattctttttctttttttgagatggagtcttgctctgttgcccaggctggagtgcagtggtacaacctcggctcactgcaacctctgcctcccaggtttaaacaattctcctgccttagcctcctgagtagctgggattacaggcatgtgccacttgtaatgctaatttttttgtagttttagtagagaccgggtttcgccatgttggccaggctggtctcgaactcctgacctcaggtgatctgcccacctcagcttcccaaagtgctgggattacaggtgtgagccgctgcacccggcccagccaccgtacctggccaagatttttctttaaaaatgtcttttttatttagacacagggtctcacctctgttgcccaggctggagtacactggtgtgatcatagctcactatagccttgaactcctgggctcaaacaatcctccgacttcaacttcctgaagagctgagactacaggtgcatgctaccatgcctggctaatttttttatttttatatttttagagacaaggcctcactatgttgcccaggctggtctccaactcttggggtcaagcaatcttcctgtctcagcctccccagatactgatattataggtgtgagctaccatgcccagcagagatttttcataacatgtttaaagcaatacagtaactggttattttgaagattattagtatatatccatagaggaattgaggggggaaaagcaacatcttaatgttatactaaaaggtaattatgcttaggttacaattttcagtgataacatcacatactaattcagaaagtattccctttgcagcaacatggatgaatctaaataacattatgctgaacgcagacacaagagtacatactgtatgattccatttatgtgaaattccagaataggcaacactaatccgtagtgacagaaagtcaatcagtggttgctggatggggacagaggagactgactgcgaaggcgcaccaggaaacattttggggtggtggaaatattctctatcttgattgggtggaggttacatgagggtatacatttgtcaaagcacaaattttacacttaaaaatggatgtattttatatgtaaattattcctcaacaaaaattattttttaagtaaaaaaaaaatctaagtaaaaaaagttggccgggcacggtggctcacacctgtaatcccagcactctgggaggccaaggtgggtggatcacctgaggtcaggagttcaagaccaccctggccacggtgaaaccccatctctactaaaaatataaaaaattagctgggcgtggtggtgcgggcctgtaatcccagctactcgggaggctgaggcaggagaatcgcttcaacccgggaggcggaggctgcagtaagccgagatcacaccattgcactccagcctgggcaacaagagcgaaactccgtctcaaaaaaaaaaaaaagttgtttgctctctctctcaacttagaagggagggaaagtgatgatatgctttgagagattctattagatgactcaaaaagcgactcatggtgaaaatacagaaatccaagattcatgtgaagagttgaatatagtttactgaaaatgtgagtgtggggaaaatcaatgttcgtgaatcaatatattgttttaaatatgtgatttaaagtatgtacctgtagctaaataaactattatatgtggacatttgcatctctaaaaagtttatattttagttgcaaaaaaaaaacaacccacaaaacaacttggagtgaccctatgatgaaaatgagtgtttgccttgtatctggagtggccatctctttcaggcatatacagtctctcactttgctctatctccacagacactaacaggtttcagtaaagccaagtgtcccttctcagtgctccaatggcccccatcacactgaattgtcatggtctgttggcatttctgtacccactgctggagtgggaacttgttctgactcagctgtgctgtcttagtgctctagaggatgcatccgtgaagcgtgttgcaaggaggagagagaaaaacagaaaagtgcaggtctgccctggcctgggctttccccttctcttcctttattgccatatgttgcctcagtgatgcagtcacagtgtccctgccacctttcagaagaagatacatctgcagcccagctggagaacctcaacatctgggtcccactatgggggccaatcagcagagatacaccaaggtcaatggagacagcagtccctgggagcagccgagccaggtgtgattttgccttgagagagaacacgaggctcttgagggacagataacacaacccaggtgaggaggaaagcaggtggacatgacctaagaagtgtgaggcctgatgactaagttggagccacagatagatttgggggccaggggtcaggagcctaaacagcaggttgtgggtggagttcaaggtgcactgaggttagttcttagcaagtagtactggctgtgtgctgaggtgcaggctggctcacaaacccagaggaggggctgttcagatgtctaacacgagaaactgagtaaaaattaaagaatggtttaggccaggtgcagtggctcacgcctgtaatccctgcactttgggaggctgcagtgggtggatcccctgaggtcaggagttcgagaccaacctggccatcatgatgaaacccccgtctctactaaaaatacaaacaattagctgggcatggtggcacgcgcctgtaatcccagctactcaggaggctgaggcaggagacttgcttgaacccgggaggcagaggttgcagtgaaccgagattgcgccactgcacttcagccaggacgacaagagtaaaaaaaaaaaaaaaaaaaaatggtttaaagaaaaaggacaatgttttacacatggatcaaattagacactgcaagactataaatctgcacccttctaatgtgaaaagggcttcactgagctatacttgtatattatgccctcgatattcactcaaggccattacaaggaacaaatgaaaacggcatcagcatttgctattaaccagttgagaacattctccactatttcaactaaataagtatccaggtgagaaacttcttttataatttaaccccagaaattttttttactccaaagaaccagttaacagaatagaaagtgttattgttttggctatcaggaagctcagccatgtttaattctcaatcacatcagctacattaacccataaaccatattatcgtcctcctccttataatctcatctcctatttctatattttattctctatttttaagtactcaaaacatttttaaagggctgaaaaagaatacacttgtggtagacatagcaacgtgccacccagatccccttcaaagaaggacttgttgacccaactattgggagagctgtcagcagaaaatcttcagctgtcagcccctcgaagatcatcttggctgcagagtgccatctggcccaggctaggctcttcccaggacattacaactcctttccaggctagtgccagacaacagagatcctgggagttggctgagactgtcatcaggcctgcatctcagtttagttttccctgtgcccactcctgtttctttccagtacctcccagagtgttgatcccagggccactccccaataaacatactgcacactaacctgtcacagagtccacatccaaagaacccaacctgtgacagcaccaaatcaaaagagactcaggaggctgaggcaggactgcttgaactcgggaggcggagattgcagtgagccaagattgtgccattgcacgccagcctgggcgacgagagagaaactctgtctcaaaaaaaaaaaaaaaaaaagagagaaaacatatcaggtaggggtattttacaaaggagagaggatatacaataaagtgttcatacatacatgggaagcaaaacagcactgactctggggccagactacctgggtttgaatcctgccttttagctctgtgcctcagttttttcatctggaaaatggggataataagagcacttatagggctgtaatgaggaagaaatgagacaatgtggataaagcagttccatagtgtttactatatgtcaaccactgttctaagtggtcatttaataaacagctgtgaggccaaacccacaggtcccgaggggcagttgggctgggactctccccagactctgggcatgggcacaggtacagtgtaggccagggcatgctgaagcatgcatgttcacagaaataggcctgagcagggctagcatgggtgacgtcacaggcgtgtgcttgtgtgggtgctgggctgctcctcccagacagcgcagctgcacgtattgccattcacacccacgcacccatatatatgctgagctgggggaagcccacacagaccacaccctctgcatgccctgtttttcctgcacctcctttggtggaaggaggcacctgaggcctgggatgctggcccagaagtcccaggaggaaatgggtcctgttccctgattacaggcctggcaacgggctgaaaactcaagctcttgttggcagggatttcttgagcccctagaggtccagacccagaggcaaaagtaaaagcaaggaagccttaccctgcatgttaggaagctcccaaaaaaatggagaaacggatgtaaaaagtgcatcagagcccacaggctgccggagtcagcacagtaagctcaatgagggctgcagcacttaagagggtgcctcctgtacaaaacaggatcagacagccagagaggggccccattcagcccccgtctgccttcctggtctcatcactccctgtcccctcctcagtcaggaaactctagctttgtaaccctaaattcaacaacctcttcctggcctcagggcctttgtacatgctgttacctctacttggaatgtacttttctccaacccacctttaataattcacctcgccatcgactcacttcctttagacctctgctgaggtctgaagagatctcgacccaatgtttttccttctagccctcatcataattgtctttatgtaacagagtgtttatttaatgtctgaactcccagagagctggcgctgtgtctctcttgtgctcctcatgttgtcaatgcccaacacagagaagagcagggtccacagaacttcaagcctaagccagttcaagccacactctgtgagcactcacgttctgctggattccctgtgcccaaggccagcggtgagcatgcctcccctcacccatgctgattaaccagatagcctccatgcccactgactactgaccaccaggacttacctaagccagtggatctcctgtgaggcagaaaactcatggagtcaggccgacttgggttctagttcccacctagtcatgttatgtggctttggggcaaattgtagaacttctctgaatctctgtttcctcatcagtaaattgtggaccatcattcctgattagaagataattatgaggatcaggtgtgaccacaggtgcacaccttcagcacagggtctacgctagctccgtcccgcccacgtaaagacctgccactaggtggcagtccatctcagctaccccaccgctccttactccacagaggctggctaggacaaagggtctcaatgtcatgctgaattctgagcttcttaggggacgcacttgaggaaatcaacgttaacacacaagtttccactacagcaagacaaagtcagaagcagcagccccaggtcactatccagctgagtgggttgcctgagcacacgctcttacaaactctagtctagtcctactatctcacaattcccaggaagcctggctctttctctggcatcagctggaagctctgttgggcttctcacctctgaaatgcagtaagttgtcctgctgtgcctggcagccgacccactgcctggctcaacatgtcagacaggctccaccgcgaccgtgggtgtcctcaattttggcggtgctgacaagggtagatagattgcaggggtgagtttcaagaatggcttcagaaagacaaagagtatgaattatattccataaccagaaaaaggccttgtggctggagaatggagagtgaaggatcacttgtgagagatgaaactggtgagatgggcaggtcatatagaacctgctaggccaagcagggagtgtggattttaggtgcaatgggaattcacggagggttttagcctggatgtaggggatcatgatttaatttcattttaaagatttaaagcatgataaatccaggcaaaaccaaactgatagatccaggcaaaaccaaacaaggtgagtagtctgggtgacaggagatggggccttcagcttgtgggctgagtgacaaggtcttgatggattggaggtgaggcaaagggaggaatcaaagttagctgcaaggtttttgaccttccaacttagagaagtttagcgccgcgttctgagaaagtgaagactgtggaaggaatcgtttggggagggaaggcgagctgtctaagggggggggatgtggaacatgcagtgggatgctggggcctggaacgtaggggagatgcaggtttggagtcaccggtgcctgtgttgttgggcaaagccaggggaaaggtcaggtcgccttgggatctggcctagcactgagtgcagaggaagagaagcttctgagatcgagaggcagcggctacaggaggaggaagaaagcaaggcggggaaaaccaaagttcaggagagcatttgcaggagggcgctgcggggtagggtctgagtcggagccccgaatcggactcgagtcctgtcgcgtggggacggagcgtgcagaggcccatgcgagggacagacacaaaggccctgggagctgcaggtcagaccactggacagcgcggccgcggacctaacgcccctgtaaggggtgctcacgcttggggggaactctccgaaagagaggaccactgaaagccaccctggcagcaggggcggaacagacagacgtgggtctggccgtcgccagaactgcctgcggaccagccccgcgctgccgggggggcgggacatgtcggctgtccatcagtgcccgcgaccaatccgcaggcagccccgcccccgcccctcccgggagagggcgcgcggaggacccgccgccgccggtgtgaggcggcccgtcctggctcccttgtccgggaagcccgcccaggtaactgagtttggccgggcattcccggaggacgcgccatcccctcacgtcccgtcccggtcgctgcatgggcggtgttcgggacgcgggggctgcgtctgtgcgggaccgcggggtagcggccgcccgtgcgagtacgcctgactgacgcgccggccgccgggcctgcggcctgtgggcggggctgccgtgcgtgacagggccgctcgtggccgccgggctgtgtccggggccgcgtgagaaagctctgcgggactgagggctgggtgggtcgaccgggaacggcgcgcgctcccgccgccatcgcgcctccgtccccgcctgcggcctgtctgggggtcgcggggcgcaggcgcggcgggccgacgggcgggggtcctccccacgggtgcgcgggcgcctttgttcccggcgccgaagcggggtggggcctcagggcagccccgccccgccgcgctgaggccccgccccgtgtccgcctgcaggagccgccgccgggtcccgctcgtctgccgcctcagcctcagccccaacctcagccgccgccgttgcgcttgctcccgggcggtcctggcctgtgccgccgccgcccccagcgtcggagccatggcgggcgccgcgtccccttgcgccaacggctgcgggcccggcgcgccctcggacgccgaggtgctgcacctctgccgcagcctcgaggtgggcaccgtcatgactttgttctactccaagaagtcgcagcgacccgagcggaagaccttccaggtcaagctggagacgcgccagatcacgtggagccggggcgccgacaagatcgagggggccagtaagtgcgcccacttcctgcctgggcccgccccgcgcgggggtcgtgggagcccggcccgactgcttgcaccccggccggccgccccagcgacttgggcaaactttcgggccctcccagactccctccgggccccgcccccgcttcgtctcgggtggtcactgggggcggggggcatccgggtcctcggtcacctgacaggacaccccccctcccccagctggggggagtgttccaggcgctttgccctgaggcctaaaaatcctcgcgggctggagacctgcggtgcaggcatcgggccccccagaccctgggagtggtggcggcgtcggcgaggggagctaaggcagtggcccccaccctgcacgggaacctggggcctgaccagacggtccccgcccactctttatccagaaagagcagtctgtgaaactctccgggcccccaggctgggctcttatttgcaaaggaatctttgggttccctaagtagaacttaggcagatgttgggtagggctggtcttggagcagagctgggcctactcatctccctctgggggagagggaggaaggtggtcttgtttggtttggagaagcctgagagaagccagtggctggaatttttttttttttttttctgctacttttgtcccaaagctgggttttggaggcctatgtgggtgggcagacactcaatgccagggcagggactccccttgccctgggaagcacgttcccaggagatgggccccataaaggcctgccccagcgccttggagtcaggtattcttctcaggagtgcagctagtttgtgagtctagccctttgtcctctgtccggtggcttcagggagcgggagcggcttctcttagtttcctgccttttcgccttcccaggcctgagcttggctgcttttgcgctggtctctagtgggaggagggagttgggggattttgaaaaaccccagatctttgagagttgttccacttagcgcgtgcctgtgctgtggtcggatgggcactctgctctgccctccattcccccgcctctcagtgtgaagagatggtgtgtctgcaactctagactgggttgcttcttgcagggacccccggagactagggttagagagacccaggctcagaaccaggtctgtgtgaaggagggagatcaggaagtgacaccccaagggggggtcccacaaaccttcttgggtatggtgtgcatgtgtgtagatagttgaggagattgggaggaaggaaggtcttgtggtgaggcagccaaccatcctcagctacaaactccagatctgacacagatctaatgcagctgctcaacttagaaatggcagcccccttcctcagtgcccccactgaccctgtcagccattgggagaacattttagtgacttgagagcctgtggattccaaagtaaaggaagaatcgacactgcaaagagctgagataaccctgggaacatcactcaggcatcaggctccaggcatggtccccttccttactccctatgctgtgttgagttggtggcactggctggaagttctcagagatctcctgggtaacagactgcattttaaaccacgcatattagcaggcaataaatgtagcacagtggttgatggcaagtctggatttgaagcccatatattcattgtgtgtttcccggccagttacttaccttctctgagccttgatttcctcatgtgtaaaatgggggtaataatatatccagtatatatggttgctccaggatcaaatgagacaattcatataaaacatctagcattgtctgacacataaatgtttaataaatatgagctgttattagcaataacattaacaatagaccgtggctgcccttcaagaccctgaactgggaatggtgagggggtgaggtgtggctataggtgaggatgaaggtgcaggaagggaggaggacggtgaccaaattcacatttcacttagattgctactcagaaaaaggcaggaaacagttttgttttgccccaacccatgtgcccactcacccacccaccatgtagaacagtgtttctgtagagaaagtgtttgcagttgtgcacatttgactcctgggtgtgacctttcttgtttgtaagttggggcctgaacagaaaagaggggtgcagagaggggatgatttatcatgcctcatgtatttgggggatggaggcaggcatacagaggacctgataaccccctacccaggggtgagcaggtgggtcagccagaggtgtacaaattcagtgatctcatcagttagctgggatttaacaggcctggagagtaggcagaggatgtaggaggaccctggcttttggattttgggggctcagattgaaaagagcctggatgaaaagtctggtcgatgcttgtgtgttcagacttaactaatggaggcttccactgaagccgtgccctgcttctacccattcgtgggctctccttgttggtgggttctgatccctgcggcctctgaggaggttggactgccagccgggttttctgccacctggactcttgcccaagcacctcaggtatctggcctttcctgctgaccctaccagggtaccagcagtgcctgaagcctggcctaagagagagacactgtgctaccttcagggtgttggtagacctgagggagagacagtgtggtttaaggagcactcatactgatatgtaagaccttcttctgccctgactctgtgccctctcttgtcagcagttgtgaaatggagctgacacctcctgatttctagggtggtcatttggctcaaaagcggggtggggaagtgcttaggtgttgacaagtttggttgtcctggtggtatgacaggaaccaggttggtgtttggccttttatgttgcagatactgacataaatgaataaaatgcagttatgtagagttccagctgagtgctattgagacctttcgtcccattttacagatgagcaaatggaaatggagaatcgtttgtgcccaaggtgttgtgtcagtgtgtgccagggcctcagctggggccagctcactagtcagaggctgactagcaaccccaagcccatgttccctgtggtccacgtggctcctctgtgagacacctttgtgctcagaccatgcattacagggcaaagaccactttggcttttgtatcccaagacagcctcagcctctctaggctctggctccacactttttcttctggtgttttctgagttgagatggttcagactcgtgtttaatgaggttgtccatttgagggtctttgtgggcccagtaaacactggtgtagacactgtggaggtactctgaatactggctgagcatgtccatggggacttctgaggccccaggcttctgtctttggctgatccttcactagatacttttctagatgccaggccctctgaggtgaaggagtatgggtgcttgcttttagggaaatgaaaacaggcaatgacaattgtgagcagtacctttgatgaagagggtgagggtggcggaagaaaacagctaactgccttgatgaggcaggcgggctcagaagggaggtagtagtggaaccagctggctggggcttgacccctgtggctggggagcagaccacaccaggaggcctgctccgagggctaggcccacagcacgggagagggcaaggcccaggccggtgtcatcaagggttttctttgtactggctgttactcccagtgggagaggggcaggagcacatgtccggatctccagagctagccatccctgcctgtgtatttcctgtctgatgtagttttttccaagggaagtcagaccttttagtgtttcctcagcaccccaggcttgccccgatgtgtgggtttccaggcccccccgcccagctgggatcctctgtttcctgtgaacctaggaaaagggcctgcttcacagataactggaggagctgagcacacccagtcctgggacccacaacacctccagcttctctccagactcttgtgtgtgtgtgtacacagatgcacaggattcagttggagtttagagatcttggctaccagctttgctctgggtagcttcttggaatgaggcacatttattaatatttgcaataagtattattatacctccccatttgcccagtgctaggcaccaaggattcaaaagtttattgagacatggtttgtgccattgatgaactcttggaaaagacagatgtagaggcatatgattataaccctgtgtgttacataccataatataaaggcctctaccaagaactgtgaggagctctgccaggaaggcattaaaggagaggtgacctttgaggtaggccttgaattactgaggcacctgtctgtgccgaggctaaggaactgggaatcactctgtgcaggggtagggaacagatatggtgtggtagagaggaagctgggactggttggagacagctatagccctagtgtgccatgtccagcagattacactcagtcctggaggcgacgggagtcagcggaggctgttgtgggactgacttgcctctgcctgggagaccacagtggcagtggtttgtcaggcaggtgttggggagggaggccagtgagctcctacggtttgcacagtttgcaggagagagctgctgagggcccagacaagaccttcttgctgaggcagggtggggatgccatggtggtagatgggagaagggctgggtcttgaggggtgagacagagcttagtagttaagcatttgggccctagactctgcttgaattaaaatcctgttgtgcagcttacttgctctgtgaccttaaagcatatgactacctctctgggctgcttatctgtaaaaaggatagtattaaatggcatttattttataaggtttttgtgaggatttgatgagaacctgtataaagtgcttagcacctgtataaagtgcttagcatggagtgtggcacagtgtaagtgcttactacgtaggatccctgacaggacagagatgaggattaagttctcaggaggacctggtggggaggagttcgaatgcacctgctgtcctaaggggctggtgcctggccaccaagccctttgattcagaggcaaggaggcccgcccatcctctcttgcagctctcagcagtccctctattgtcagggctctttcccactgctggttttgcagggagacagggcagttggctggaagcagctgctttgggtggtaaccccttctgtagagtgaaggtatgatattgtcctatttctaagtgcctagcccaggacgctatctggagagatcttgtctttgaggaagtgctctaatgccacagcctcgatgtggtagggcctgcctctgctgtcactgttctgtgtcagtctccgttaactcacagcatctcttcttactctgtgccttttcctgtgggatgtggcttcaaggagaccacagatgataagttggaggaagggagtgaggcctgagattgcaaaggtgtgatattaggagactgatttttccccctttccacttgctttgttagaactagagaagtcactgcagactgtgaggagagtcctaggagagatgggtgtgggataggaggatgggaatgttctggtgccccttgtagagtgccttgttgagaggagcatgggaacagtgcgtccttggagggaatctctgagagcagcatgtttacaggtggcaagactcaaggtggagccacgggtgaggagtggcttcaggctaccattgaccagatagtcccaccttgctggtaattgagctgaagtgcctggagatttgtggctagagctggtcagatttgggttcaggtctcagctcttactgtgaccttgggcagattacttttccctgtctgaaattgatctttagctgtaaaagtaatttctcctcacagagctgtatattaataataagggagattatatataagagtaagagattttatgtgaaaactacccagcacaacatttgtcacttagtggccacttaacagtattcatttcctttactctcacctttgttaaccacagagctccaatcttttccaccactaagctcggccacaagtggctgctccaacaacctgggctaggagtctgtttcctacttgctttctgtgttccttccctgagtctgtacacagaggactggggcatcaaaaaactctggaattggaatagcatattgggagttcatggaacattttctcacctgttgtattgtttgaacttcacagcagctccatgaatccatggagggcaggagttactatccctctcttacagaggagaaaaccaagccctaagggtaaggtcacatagcaagttcatggcagatcctaggatttcagattcctgctatagtattcagtttattctcccattctggggaaaatgataataggatggaccgttctataggaacagagggttattttgttttgttttgtttttcttccctctggccacatgtgtttgaccagcctagacttccatctgtggacaagctggactcattgcctcaatttcaaaacccgtcctgcactcatccttgccacaacaccggtgtcgagatgcttggcccacccagacctttcccacactcctacatgggggtgaatgtagccgctgattgggggtgggacacagaagagcctcaccctcttgactttctggtttgtggtgacacttccgcctaagcttctacagaacatgggaacctggggctccatgccccaaatatcctgagaagggcttttccaggattctctatgacaactcaagagcatgcattcattcatgtgctctttaatttgtcatacatttgttgtgggccttgctactgtgtgttgggcacactgagctggatgtgattactccagcctctgacttgttcatggtggcagtagatctctagcgtggtttgtgttccatctcaccatacctactctccttaaaaaaaaacaaaaaactagctttcttgggcctcagtggctcattgaataagtgagagacgacttgtgcttccctggctttagactctggcatttgctaactgtgccaagcactgtggagaccagtagtggacataaggttagggtagatacagccagaaaggagataaataggcagacagataaaattcttataggatttggtgagttctatgaaggaaataaggcaagaggctgctctgtcagggtaggtgagggtgtgctgtgataacaaatgatgcccacatatcaatggctggcaacaaggaaggttaatttcccctgtttgctatgtgtgctaacctacaccaccgtccctggagagtggcctcagtggttctgggtgaggcctctagtacagaacctgaacaccctgggcaaactaggctggagagggatttggagtatggaggtttagaaggaattaatttctatgacttaggatgcatgtggtgagtgtggctttgctgttgtggtagagtagagtgctgcctgtgtgggtcaagagactgtcttggctgacatctttgaaataggtatatttgtgtggcccttgcctaattgtcatctctgccatagctgcccccgccttccccaccaacccatggccctacttgagctgcctgctgagcctactctgttgtggccacagtatcctcctgctgcccagagtttgagtttctcgctacttctgccactcatcacacttgcttcccagagctttgctgggtgtgctgaagtctccagagaaagtggggaatatgggtgcctagagacttctagggggtgttttcagcccctagagagtagagaagtgtgagaaggggttggtccccgaatattctgtagttttggggaagaagcaatggggacagtggagttggttgccttaagagaggctatggtcccaagagatgggacttggagagtctctacttgcattcctggctaagcccttaatattctcgcacccctccttgcaagactagttccttttgaggtggttcttggctagcttttgagaggctgcagtggctgtgtgcccaggcttaagtcctagctttctccccactctttacctcctaggaaccgggcccatcctgggggaggcagggaggagctcctttttatagtccacatgtaggctttgtgtataggctctgctgcttccttccggccctggcccttcctggtgttggccggtggccctggcttcagcaagactcaggatgcagagtaaacggggcagggcgttctcctacagaagactggcatccctttttactgagcccaggcctggcacagaggaggctggagttaggaagcaagaaaacgaggtgacccagtccttgatcctgagaagcttgtgatctggaccatgcagaaaaccgctaatgcccagggctggcaggagacagctgtgcctaaagtgctgtaggctgggcctgagggccaagatggaatcgcttttctccctgtagcagcccatcctaccccctggggtccctccacctgccagctggcacacaggtgttgggtaaagcatctgtacaaaggctgtgaggggcctgggcgcaaggcagcaaggcttgggtacggaggagagtgggtggtcttactgatgttctgggccctgacagtgaacagctggccaaactggtgaggagttgggccatggcgagtttggccacttgtttgtgtgtgtttagttcttcctgggcacaggtggggagttcactttggggttggcttcctgttttcttggacacctggggatatggttgagttaaaatgttctgagggaaatgattgttgagggcatgggcttgggtcatagtgtccttggcttggccttgcccatggtaggagtcgggtattgaccacactgggttctggctgtgtaggtgtggatgtgtggtgggagaattccaaccccaccttgacttcagcctaaggcccagagagtgtgggcctgagttcacagggtgactaaccctaggaaggagtgaaggagagctccagttggccataggtcccacaggtttctcagcttacttgggggcaggaggtgagctaaggaatacaactccattccctcagttgggaggttgggcagcgatgggggcaggggtgatggtccttctctgaggcactgaagacccactttatggtcaccctattctgcctgatagtccaccacctgtttggaggcagctcccctcttcctgccctagtcacttcctccaccttcaacagtaattgagtataatgtgcctgtgttagcttgtccatcctaactgggactgtggccttttcttgggcgttcttagcatatctaccaaggaggttggaaaaggtaacatatgtcactttgttaaggattttgctgagggccttttgaggccagcagtgaaacacagagcattccctccagtgagaacagaatgtctgttgccagactgatcacaagaggatggcctggttctggcctgagaactggtctacaccggaagcatgaagctccatacaatcatgtgtgctagtaaagtttgggcaagcagctgtcctaagcaggtaaaacgataggttattcaacttcaacttcagagaaagaaatccaaggtagccatctctctcagtaggggaggtgagttcaaagaatttaagctgggctgggcacggtggctcacgcctgtaatcccagcactttgggaggccaaggtagggggatcacgaggtcaggagttcaagaccagcctggctaagatggtgaaatcccatctctactaaaaatacaaaaattaaccaggcgtggtgtcaggcgcctgtaacccagctactcaggaagctgaggcaggataattgcttgaacccgggaggcagaggttgcagtgagccaagatcgcgccattgcactccagcctgggtgacagagcaagactctgtctctttaaaaaaaaaaaaaaatttaagctgggctttctgggcaggcagtgagtgaatgagatccctggcaccttggagtgagatcagagtctagatcactcactggggccctgtttcccaggaagcaaaaagggaacaggagagtggcttggcttgggctggcatggcgcaaagggagtgcagccagatgctgtggcggctgggtcaagtagctctaaaacaggagagcctagtgggttctgctgaagcaggatgtctcagcaagcaggcctctgacctgacgacttccggtcattatttagaacgtctccagccccacagatttactctgttggaggcttaaggactaaaccaacatttactgtccaagaggtggcagtaacacagaaaccaaagaggcaggaaccaaggttggggtggtgagatgtcatggggttcagggagtggcagaggggaaggcctctattctccctttcccacttgtctccctacctcagcccctgttgctctgacgcttcccccaccactatgagtcctaggcccctgttgtttccttgtaggagggagaccccagatttttatttcttctcccaacccattccatttcctctcccttgtgagagggctctgcagagacagggcagcagagagagacttggagatatgctgggctgtggtcaggagggcctcatttatctagtgagcaggaacaggttatatagcagtgatgctttcatagtatttttcttgaataaggtccccaaaaccttattaagttcctggtaggcatggagcattgaagatggcagacatggtgcagtctctcaaggagtttacgctctagtggagaaaacaatcagacagccttaaaatacatgtatggctactataataaatactgtgaagcaggagtgcaccacgaaacctggagtcctctccatcctccccttctgtctgtgctggccctgcttggccacttccaacaaggattctgaggcattacagagcacacgtctagggtacaggcagtcttggctttgaagtattgttggctttgccactcaccaactgccaccttaggtaagttaattaacctctttgtgctcaatttcctcactcgggaattggggaccctaatacttacttcatagtgttatttgcaagtataaaatataaggcagtttttatcgttgtaaggcagtcttatcaagagctttatgcaatgtctatgcaaagtaaatatgcaagaaattagtgttaggatgccagatgctgctgttgctcatcgtctcttcccacccagcagaggtagtaactacttcatcctctacttctcagcttcttatagtatttgtctgtggactctaacgtaagctatctagcataatactcatatctaatttttccttccacattcaagctccttgaggtacttgtattccaagtatctagtttaatgtctctcatgtaggtgctcagaacgtatggttaattttgaataataaagccagtgggacttctcagagggctggattgggggctggtgagagaaaaggagatgcgaaggatcattctgaagtttggagtttgggtacctgtttgaatggtgatgctcttagctgacccagggggtatggcaagaggccttggttctggtgagagagagaagacagtgtttggttttgaggagttgtctttgagacgttttgagatgaagagtggggatagcaagtaggcagctgaattgaaggatctgaagcttaagaggagaggactaggctagagacctgtttgtgaattatctgtacataggaggtaattaagggtgtgggcatggctgacactgatgaggaagaaggcagagcaccggaagagaggaccttgacctgagccttgaccaaggccattgctaaatgcaggtaggcctgtagcgcacaaagaagcatgaaaaccaggcaaggttgtgcaggagaaatcaagggcagagcttcaaggagagagggcgtgatcaaccatgttgattgctctgaggtgtcaggaaggaggaccatagataagtgatttatgggtcaggcacggtgattcatgcctgtaatcccagctctttgggaggccaagactggcgagtcatttgagcccaggagttcaagaacagcctgggcaacatggcaaaacaccatctctgcaaaaaatataatcagcctggcgttgtggtttgcctgtagtcccagctacctgaaaggccaaggtgggaggatcacctgcacctggggaggtagaggctacagtgagccctgttggtgccactgcactccagcctggacaacagagtgacttatgggccaggcatggtggctcacacctgtaatcccagcactttgggaggccgaagtgagaggatcacttgaggccaggagtttgagacaagcttgggcaacatagtgagaccccatctctataaaatataaagaaaaattttaaaagtgacttatacccattgctctggttctccaagtagcctgagtgtactatgtgggggagcattttatgagggacttttgaggtcctgggcatccctgagacatggccctggtgggtccccagtctctctcctgtagctaggagcctggcatacacaggccatctagaaagaacttaggcagcatcagtctgcaagggaggcagagtttggagcacactagactcctgacacagaggctgacccatggctgcctggagaatcttctgggcttgtgcagaaaagttggggaaagccacctttccctactgtggcagtcaaggcttggtataggccatcttccctcccttctcatccatgatactctgaatgccctgtttgtggaacttagtggactcctgcacctctgtcttggtttccatgaacccctctgcccaatgtgtgcttgtcagccctccagacctggcttttacagagcactccaagacattgctctacacacactcagctccacagacacctccctgttgttctactcgttgcatgacctcatagttatctgcttccccatctgtttcctccatcaggcaggggttttctcaaaggcaggaactcaaatgccttattgatctctgtttccctaggacccagcccagggcctgacatggagtagatagatgcccgataaatgtttgatcagatgatggaatgaatgactgcataagccgaatagatcactgctgagtgctcttccagctttaatttctctgggtgggacctcctttcccttccttcctttggattctgttcttacctctgaaataggtgagattaatttagagtcctagggaagagggctgcctgcctggatggtacaaaggctggctgtggctgctctgtgtttctctgtatacccagtgtcagggatagcagctgctgtggggacactgcagagtgtcccagttctgccatgactcaccatatgaccatgacaagaccctttggaccctctgtttcctcattgtttcaaagagatttgtctagaatctagaccaagcttgtccaactcgctgcccgcgggtctggtttgaaggcagctgctgcacagtaatgggaaggacagtaagccccaccatcgccttccctttgccatataaccctgtgacctcagaagtccctgaacccagatccttgtttgtaaaatggaaagggatagctacccacccctccactttgaccttcctttggtggcagccagatgtgctcagggaaacctcagatttgtgagtatgtttctactgagaggcaggaggaggaatattatagtctcaggaagagggaggaatgagagggagaggagaactctcaccctttccacaggctttgggcatatgcagccagcttggaaatgctgaccatcctgtgacctggctactattgcatcaggcttccttcccacctgtgtccaggtcctatctttgtctcttctttggctacctccatccttttccttcagagctgcaaaaaccttgccaaagccgtatggtcctgatgggtgcagagcccctgtgcctctggctgcctgtgaagggggatctgcagtgcagtgcctgccgtaccccacagggagttgtataggaacctggggatggggtgactgaggtagggggccagaagtggcccagatgatactcacttctgctggaacttttctttgtccatctttcagcatcctctggtggagaaggcttagctccattaatgctctcctaggtcctggctgtgtattttctttggtatgggagtggggaactgggagggactcatctgtttgccacagactacatgtggagagggtgattggtgagaggtcattttggagatctacacacctcttctgacccctgggaccactctcctgaatctcctcatggtcttggcttcgggcccagcagggcgtgggtgctcggcatcctgctgcttttactgtttttcccaaagctctgttagcttcccgtggttcccactggctataggaatctttatgtaaggacttcccagtgtttccagactgtatttgcccccaggggtcacattccccccaactatgcctgctgctgctttttctgttcccgttgttacctcactgaccactgcattttcagtatttgttgtagcccctcagcctctgtggcccactgtgccacctcttccaggaagccatccttgataccatctttctggtaccatttttgagcatctgtggcctttgctgcctgttagataattagctctggaatctaactcccatgtgtttactcctgctcttaagtactctgaacattttgaggcctccccaggccctgggtttgtgttggactggtagggaatggagagaagagtcaaatgtggtttcttccttggaggagctcataggccagtggcctaagacaccagggaagcaccagcaggtgtgacaagtggtgacacacaagagaggagggggcacctagtgtgcccctggcctgggcctggtgggggcttaagtgaggaggtaggagtggcttgtgcaaaggctgaggcaggaaggagtatggggagacatgggctggtgtctgtgttgtgttaattggacttggacccttttgaggagggctgggctttccctgccttcctccagtgccctctgcagagtggggcacacaggccttgaggggttctggggtccacaggccacaggtgggggtagtaaaaacccccagaagggaaggaacctgtccaggaaatcttcgcttacctctttcaagctctttagattttaaagagacctttcatatttactatgagttgcagtttttttaagttacaaaatttctttactccatgcatgtttaaatggatagtttttgctaccatttacatcaattagcttacacactttgggttttgtgtttttgttttgtgtttttagagaaaggatctcgctttgttggccaggctggagtacagtactgtgatcatagctcatagagcttcctactcatctgcagcctcaaacccttgggctcaagtgatctttcccaccgcctcccaagtagctgggactacaggcatgtgctaccatgtctagctaagtttttttaatttttattttttgcagaggtggggtcttcctctgttacccagatgggtcttgaactcctggcctcaagcagtcctcttgcctcagccttctaaagtgagcgtatgcactttataaagggaaaaccctctctgaagagaaatatttcagacagggcatggttgctcatgcttctaatcccagcactttgggaggccgaggcaggcgaatcactggaggtcaggagtttgagagcagctggccaacatggtgaaaccccgtctctactaaaaatacaaaaatcagctgggcatggtggtgtgcatctgtaatcccagctacttgggagactgaggtatgagaatcacttgaaccccggaggcagaggttgcagtgaaccgagattgcaccactgcactccagcctgggcaacagagcgagacacccagacccagagaaatatttcagtgaaagcatgtttcatgttcagaaatttggggtacttttggttatggttttcttggccatatcttcatcatttggtgggtttagttttcaatatgtcctcctgtccctttctgattaaatcacttctgtatctcttacctcattggcatctcactgtagtccaatgaaggaggtgccaggagtggtgattctattttgcagatgaagaaaatgaggctcagagagatgggtccaggcctcctgcccaccttgccagtgcttttgttcataatacctctctacaccctttttgcctgctgagcggttaacaggcttataaatttgggggacctctgtctgttgggctatttggaagtggcttttttgagcacaggggatactaggacacaggttccaacaagaaacttaggtctaatttagggtcttggatttgatgattgggctccctctcccccttctagggcctgccatgtgtctgccccctagggcaggattggctggctctcactggctgtgctctgaggagccctgcctttgctcttctctttctcttccctagggttcctgctgtccttgaactctgccggggcaacaggaatactgcccttatgcacatcctcgtggtggccagacagggtggttatcccactttactggacaggaagagagctagtggcaggcctgtgacttggcctgatgtctcgggggagtcggggtgggagcaagagtcaaagacaggaagcagccctaccttcagaagagccaggcacacagatgggtcctttgtggttattgtcttctccctttcccaggttccagactggctgcccgccatatagcttgtcccttcgacagcaccctctctccccactcagtggattgggtgctgtcccagggtgggggcttactctcctgcagaggcaggttctcagctggccctgagggttgtatagcttcacagctcccagagtgcttgggcatagggtggctcagatgaggaaacaggctcctcttttaaagggaaagcaactgccattactggcatgtccaaaagggggatgctgtccaggactgcatggcccagaagctccgctctgagtaactgctggtctctaatctctgtggtctcaggccaggagtctgtccctgggctgagaagggaggggagaagagggaagagatggaaaaggaacattgctcttcccagtctccctggcctcgtcatataaccttttattttacaaattcagtcttgtggcattttgctttaatgcttagagctggccccaggtgccaggcagcaggcacatttccttctgcccaaaaaacaaaacacacatgaatctgaggttgggcgtggtaagggcaggccaaggctgaccgtcctatgtggatatctgtgaggtagtgtgcctacatgtaagggtctgttgtgggtctactcccacgaaagccttcatcttacgatgaaccagagaggactgcagacttgccaaggcctagctatatgcttggagccaggatttgaaacttgatctttggggatgcacgtgcctcagactattggtgagtgtgctggtggggcactgcaggctcaggaagcagcgtgtctgcatatgcttatctgtacacaagtctgtaagagtcccccttctccccatacaatgcccccatccctgccaggcttctttttgagctggcgaaatagctgcttgtattcttctcttcatggatcatctttatttcacccaagtttgggtttgcacctagtggagccttggcaagtggccttatttgtctccactactgccagcttttgtaggctccatgtcaatggcactaggcacacaggtagacaggtgggctgtctccagacttctctattaccagcacttcccagcatggccctcacagcaaccatgtgaggtaagaggaatttccagtttcctgatggggaaactgagaccaaaagagtgagggactgccaaggcctcatagctagaatttaagagctgtgtggttctcctcactaagctgggaaggggatggtcagggaaagcttcttgaaagagcaggagaaggcagatctccatcagggcagggagcagagcaaggccccaggattctgcctggggcaccaggaagcctggcttatgagaaggttctcagtcctcagagctgacatgtgatatacagtccaggcacaggtgtgtgtggtccctcattacttcagagccccttaagaaagactgaatctatttcttcatcagagtttgtgagcgattcaatataagggactaaatccccctcactgccccaagcagcttatcttgtcactgtctaccatagccacatttggaatggtaatgcccaggccattcctgaagcccaggcagcattcactgtgggcttggggacatggtgccattcctgaagcctgggcagccatcaccatgggcctggggacgtggtgctgggcagaatgaatatgctgcagccctgatgggctgtgctggctgggctttgccttcttgggtcaaggcgagcctgggcattaggcctttgtcattatgctatacatcaggcttctgggctgctacttgtgggatcctgcccttgttctcaaagagttcctccttctcactgccccatcttcttcatagtgacggcctcttcgtacccctggcttttcttttccccagagttcccctgaatgttgtcctctcatggttctgagttggggaggagtgctaggtcatggatttttgggtataacgtgtgactttcctactcccctaagtagttctccccttctcaagctcctaagttctgggaaggtctcttttcctgccctcctgactaatggcagagaggtctgacccagactgtgccagactggatcattcgctctgtcacctgccaccagggcagaggccattcctctctggggagtctccttgtgaatttctggggaccagctctggctctctcaagaaagaggatgctgccatatttgttctgggaggcaggaagatgaagggtgaggttgggaggtagcacaggatgtggctttcaagaacctagtagagcatctcactgtgctgccagggccaggctggtgccttcttacggaagacagtacaagggatcaggtgtggccaacaggaacttgggagcattggatgcctggcgtggagctgcgctatgcttacctggttcctatctcaggcacctgttctgccttcaactgatctcaatggaaatatgtgcaggagtgcaggcctgttgactctgtgtgtgtgtgtgtgtgtgtgtgtgtgtgtgtgtgtacagtcacactcacctttgcaagaaggtgtgggagggggatgacagcagctccacaccggaagagcagactggtttctgtttcaaaaggcagagtttgtggttgttctgcagtttctgatctagccatttcccctgatggaagctcctccttctgtcattggaagccctgtgttctcggttaggtcttttatggcccagttctccctgcccctgtttctacccgagtataactgttcatttttgttccccatccctatttggttttccctccttctgcctgtgtacctgcctttttcatttcttcagtcattaagcaagccctggaggggccctgcctggccttaggtatgtgagcatgtatgtacgtgtttgtatgcacgaggcatcaagtgtattagtaccacaggaaggagcttctcagttgggcccttggtggaagagaagggagccggggaggtggacatttccagactaggaatcaagatgaaatagggatgggaagcaacagctattcttgccctaggtgtggcttagtgtggatggagcagagagggtgagagggcaaaagctggggaggtaaattcctgagccctgtcacaaagagccttcaaggccatagaaggtgtttgttgtttgttctccttagactggcagtgggcagcctcgggaggggcttgaatgaggtctaggggggtcagaataatgttttatgaagagccagaagactggggaaggatggctgatgggtgagaaccaggggtcagggaaaacagcagaaaaggcaggactctcagctggaggacaggctggaggggtttgctgaggggacaggtggttccaggtagaaccagaaatgtgtcggggagctagggttagggccagaagcaatgcccactgttccaggtgggatagatgtggagttttgtgacagttgctagagggacaggacaggaagagagcatctgggggagttgggccgttaggacattccaggcaggttggtgtgcagttcgggctggaagggctcctggggtgggggctggccaggcaaatgctggcactgcatctggctccgaagttaccaggccagtctgggtttagaggattttaagaggcttcagagcttggggagtactcaaagaaagtcatagctgttggctaagccaagcttttttcctttgacctaatctaccttaaatcggtgatttctgggctggaatgtctgccctccagccagcaggcagcccctccctgtgctggagagtgtgtcagagcctgtgcacctttgctgagggagcagaggagtccattggatgggccccctccatgtcccacatatagtgctgggtgtttctagctgttacgacttttgatcttaccaacatctttctgatgctattgtgttactcttatgttactctcttcacaggtgtagcagtgaggtcagagtggctgtcactttattgagatcacatagctaatgtgaggtagagctaggattttagttcagccagtctcacccagagctcgtgcatgttttttctaccaccctgccttctagagaaactcagtcaagccctttgctttacacatggtaaaactgagactctgagaagttaaataaattattcatcattgcctcaagttttagtggctgagggcaggtcatctgctattcaagcccgtgtacctctctgactatgccttgtgaaggccacgggagcatgcaagggccttggatagctaagataaggaaatggtcccaggcaaaatggtggtctgggtccaggatggttgctgctcttggacagccagtgccttggtcaggggatggggtggggattaggccccttgctgagacttgtgtggggatggctttagcagttaggcatttcagggatgcaccagtcctctgggccagagcctactttctcccagggatcctgaggcccatcttgacctacccagccctgcctctgggactttatgatttgatttgtgtgtaccttgtgtcaggaagtggtcctcatgaacagccttgggtccctatttcttcttctggagtctagctcttttgcaggtcaaaatgtctcagtgagggaacaaagatagggaagggacaccccacagaaccacctttcccccatatagccctctctgacatctcagcccttacttagcaaaggcctatccctagactcaacccagccctcttattaccagagtgactgagtggtcttggctctgcctctggggttcctccctgagagagagtgtaagaatgaggaaaccaggctgccctcctttcggtgttgactctgggagaccccagcttgatcttggcctctttgctaccttcctagttgacattcgtgaaattaaggagatccgcccagggaagacctcacgggactttgatcgctatcaagaggacccagctttccggccggaccagtcacattgctttgtcattctctatggaatggaatttcgcctgaaaacgctgagcctgcaaggtgggagttaagggggtagaggaggtagaggatagttaggggaatgcctgctggctcctgcccagtgggaggtatgtgccctcggggcagctattgataccttgctcacagccacatctgaggatgaagtgaacatgtggatcaagggcttaacttggctgatggaggatacattgcaggcacccacacccctgcagattgagaggtaagaaccactcctgaaggggttagggctgggagcattagggaccagggggacagggacagcagacctttgtgtgcccagacatctcccaggcctgactgtagatggagaagtggccctcacctcaggcttctctctccaggtggctccggaagcagttttactcagtggatcggaatcgtgaggatcggtaagtactgagctgtggctgtagcccagcagggtggggatgggcatccagaaccttagccaggcctctaagtagctgcccggagagccagaggacccaggggaccttaagtggggccaggagggtgggcagaaggttctgccacgtgtagctttctgcacaaagtcctctggtggccttggtgtgagctggtgagaggagccagccacatgctgtgtgccctgccactatgggcagagactggatgtgtagaactggctttgggtgtcctggaggtgagggtggccagtagcgtgtgaagggtgccctgaaactctggctctgagacctggtatggcagccagaggggccaaggagagaagggggagcaaagaccagatagtgtgggtgctgcaccatggtgaggtcctttgacctgaaagaaatgggaagccatggaagggttctgaggagaggagtgatgtgacctgacttgggttactcaagatcactctgcctgctgtgtggagagctcagttaggagctgtttccacactccaggtgaaaaatgagagggcttggatcatgatggtaatggtaggaagtggctggattttggccatgttgtattttgaagatagcgccagaaagaatgtccttaacagattgattttggggtgtgagaggcattgaggataatagtatgctgtttggcttgagcaactggaaaacagagtcaccattgactgagatgagaagatcatgggactagcccatttggagggaagcttgggttcagttcgaggcatgttaagttttctgatgcctattagctgtccagggagagatgttgagtaggcaggtggttagagtgagtttaggtacatacacagtaggggctacagattttaacttgggagtatgtagataacactgaaagccacagggctgggtgagatcacctagggggcaagcagaccaagaaaagggcagggtccagtggctgatcccagaccacccccatattagagattggaggggtcagggacaactagtgcggtaagaggagaacccccagagtgttgagttctggcagcccaaggaagaagacagtggtgaaatctgaccgttgacccttggatttaacatggtgagaagagcggtgtcaccctagcggtgaggggctcaagggaatgagagggagcaagatgactcttgcaaggagttttgctatggaggggagcaaagaagagggcagtagctggagagctaagcaggggcaagacaggtgtttttggtggaagaagtaacaagctgttcgtatgctgatgggaaagagaccacagagggcaagatcggtgatgcaggcagttgcaaccagaaggcctctgtttcctcactggaaaacaaggaccctgatagcacctacctcctgggtgactgaggatcagaggagggggcgcctatatagagccagccctccctccgcagtgcttgatccactcagtgtggcgctcagccccctcggggaattttggtgcctcctcccaggctcttggggcccagaggaggtggtcccaccctcccctcccctccttgacaccaccttccaggagagaaagccccccccttcccccttcttgtccatcctgttgccaggtccagcagtgtccccagcctcacatcctgggcaggacacccctggagagcaggggcgcttgttctctcagtttctttcctggagccaggccctgtctagccccaggaggtgcccagttgccagtcattgtatttggtggagcatgcacctcctccttcctccctctcatgggttagtgggttctgaggaccaaactcccagcatcccagtgggcagcaggtagggacctgctgccatgctgcccccaacagggaagttgtgagtgagccctgccttctgtcttggataggctgactgccaccttggcacaggcctcagcagtgccggtaggaggggaggcctggagtgtggtttttcttcctcccatgcctgacccactttactgaatctgttcacatcttccttgccagaattacaggttttttttgtttgttttgtttttgttttttttttttttttttttgctcagatgaggaactgaggtccaaagaaaggaagggactaacctcaccccatgggttctgatccagtcttgccctcaggcctccaggttcccagaatagtgttgtttacctgtccagccccaggtgggctcgacccacaggtcagaggtcatgagaagctggatgagaccactggggatgtccctgttttctcagtatatcagccaaggacctgaagaacatgctgtcccaggtcaactaccgggtccccaacatgcgcttcctccgagagcggctgacggtaagtgccacccagggctgtctgtagatgggggcaggggaagccaagagcccttcagctgggggcctgactgcctgactggcactcctgctctataccatgcaggacctggagcagcgcagcggggacatcacctacgggcagtttgctcagctgtaccgcagcctcatgtacagcgcccagaagacggtgcatgagccacctgccctccctcaacccctgcccctgctcttccaccccacaccccagctctgcctgcctcagccctgctgccctgcttaggggcttttgggtgccatttctccagttcttctcctcttgaggcctgcccccatctgctgctctagcctgccttcttactagcccatttcccacatggcctcccaggggtcttgccctgaccaggttctgtttcctgcagatggacctccccttcttggaagccagtactctgaggtttggtttggagtggggaggtggggttttccctgggcccccttcatctctccactgggcgattcttgatccaggtgggaggcagtgggagtagggaaccatgctggaccattctgggaagctgtgctggctgggagttgggttctgccttccgtggggcaccttgttgtctgttgaccatactagctagcttaccttctctccctgcagggctggggagcggccggagctttgccgagtgtcccttcctgagttccagcagttccttcttgactaccagggggtatggctgggctgacattggcccaggctggtaggttgtggggggctgggctcatccctgactggaggcttctctcatcccctgccctccctaccccatcaggagctgtgggctgttgatcgcctccaggtgcaggagttcatgctcagcttcctccgagaccccttacgagagatcgaggagccatacttcttcctggatgaggtgagcccgatgtttcacccattttttgtcaagagaatgagtaggggtgaccaggaccccacccgggctccaggagctagacgctccttagggatgccaccttgtttctacctactgtgcaccttgcccacccccagttgggacagagcactctctctcctacccccaacctaccatcttgggttggacagggcagggactcactgtctcttcccttccacatgtttctggacagtttgtcaccttcctgttctccaaagagaacagtgtgtggaactcgcagctggatgcagtatgcccggacaccatgaacaaccctctttcccactactggatctcctcctcgcacaacacgtgagtgtggctccttcaggcccacccagcttcttccccaggagggcccatctgaccatacctacctgcctctccttgcctatccaggtacctgaccggggaccagttctccagtgagtcctccttggaagcctatgctcgctgcctgcggatgggctgtcgctgcattgagtgtgcgtggggtccagggctgggggagggaagatgggaggcctgcccgcttgaccatggtgatgttgctccccagtggactgctgggacggcccggatgggatgccagttatttaccatgggcacacccttaccaccaagatcaagttctcagatgtcctgcacaccatcaaggagcatgcctttgtggcctcagagtgagtcggaggctggatgacccaggggttaacttggctccaggtctctcgttctagagggacagagggcagaaagactcctcaaatgccctgtcccctctccctcagcctttcatctttgtccttcctcttggcctctcctcgtcacctgctccctgcttgagctgttgcttcccaagttacactttctgtttcctacgtgttgggcccactctcttcttcatgggtcctttagactgtagaacacatgctcttctcatcttcagaaaacatgccctggtttctttaggccagtgtcctgccaactcctttgccctcacagcccagaagattgtctctgttccctgtgtcccattccttcaattctgtttactgcttaaactgtggtcactggtctcccttagctcaccagggctctaacagctaactttggaggcttctcctctctcctggcctctttggtgtgaaacatttttcttgcactgctgagcagcctccataattgggccagctcgggactgcatcagttgccaccctttggtttccactgctgccacagctgtagaacccctctctgccccaccagtggctatggcctgcctcttttctgggatagtttttacagacaagaagcccccaggcccttggcttccaacagctcactgtgaggggctacttagacccagagaattgcagaatctgtttcactgtgcttgtcccccatcccgcaggtacccagtcatcctgtccattgaggaccactgcagcattgcccagcagagaaacatggcccaatacttcaagaaggtgctgggggacacactcctcaccaagcccgtggagatctctgccgacgggctcccctcacccaaccagcttaagaggaagatcctcatcaaggtggggtggcgggcttattgcggaagccccacacttctcagtgccttgcccaggccatggcttcagctgttgggcctaaacctgggtgaggaggtggggtgaggactggggtctgcattgccctgttctggttgcccctacagcacaagaagctggctgagggcagtgcctacgaggaggtgcctacatccatgatgtactctgagaacgacatcagcaactctatcaagaatggcatcctctacctggaggaccctgtgaaccacgtgaggactgggccaggctgggggtggtaggccagtgggtgtgaggaccctggctcacaagtccctctttggtctgttccaggaatggtatccccactactttgttctgaccagcagcaagatctactactctgaggagaccagcagtgaccagggcaacgaggatgaggaggagcccaaggaggtgaggaaccagctcaggtctgggggctgggccaggtcaggcctgggccagggtcacagtatctttgctgttgccttcccctgacaggtcagcagcagcacagagctgcactccaatgagaagtggttccatgggaagctaggggcagggcgtgacgggcgtcacatcgctgagcgcctgcttactgagtactgcatcgagaccggagcccctgacggctccttcctcgtgcgagagagtgagaccttcgtgggcgactacacgctctctttctggtaacacttcccatgcagatgcgtatgttcagtcagcgtgtgtacacagacatcacatcacccagagataatcagttaacatttgagcctttgatccaggacaataattaggctttacatggaacataatttcacctacatacacacacacactctctgtctcaccccccccccatacccctcccttttcggttcatttgaagcccacacctttggttcatgtgactgcccacacctgagctcctcaggagattggcctccctccttgaggctccctccttgagttccaccctcatttggggtggaacttggtctttggggccctggcctgttttccccagcctccctcactctgtgtcttccacaggcggaacgggaaagtccagcactgccgtatccactcccggcaagatgctgggacccccaagttcttcttgacagacaacctcgtctttgactccctctatgacctcatcacgcactaccagcaggtgcccctgcgctgtaatgagtttgagatgcgactttcagagcctgtcccacagaccaacgcccacgagagcaaagagtgagggaagggcctgggggcggacaaggcagggcagggccatgggtggtgctggccgggcctgactctgcctgttctcaggtggtaccacgcgagcctgaccagagcacaggctgagcacatgctaatgcgcgtccctcgtgatggggccttcctggtgcggaagcggaatgaacccaactcatatgccatctctttccggtgaggggtgtggcactgggttgtggggccttgcttgggtctgagctgccctgaccctgtgtgactgttttgtccttgtgaagggctgagggcaagatcaagcattgccgtgtccagcaagagggccagacagtgatgctagggaactcggagttcgacagccttgttgacctcatcagctactatgagaaacacccgctataccgcaagatgaagctgcgctatcccatcaacgaggaggcactggagaagattggcacagctgtgagggggctgtggtagacggggcatggcaggggaggcaggagagacccagaatcttaccagtctctggatgtgtgtaacagcaagacctggtgtgttgtagaagttcgtgggagggcccctgactccagctgggagccacagtgtgggtaccaggagggtgtctgcaggaggggacatctgagcagcatctttaaggatggggacaggcacataagcagagggttcctcatgagtcaagatgtggagtgaggaggttctggggctcacactgggagaggtgcacacagtggaaactcatccacctgggcttggcctggactctgtcctagggcagatgagatgaggctacccaagagtggttgtggagcctccgcctggtggatggtatggagggcagagccacaggaggtgagaccagtgagggaaaaagtcaggacccatggcagcacagctggtgataagggccctggacagaaggaaggggtctaggaccagaagatcagttgagagactgctgtcgtcagtagacagggctggctggggagagagaggcctgttgtccactggcacctgggactcaagtgatggagaggagcggcaggaggaatgtggggagtgggaaggcttttcctgactttgggctcagcagtgaaccaacaagccactgaactaaagcactgaatatgggtagtctgtgaagggcccacctgcacatagctcagaaatacttgggagtttgggcatttaggacctgagagattttagaatcctgggctgggccttacatgtaagaatgtgaagaaaggaaagggaacagtgaggccgggcctgaggcctctgaagccgtctctactgaggtcgaaggatccctgtggatcaggtgcaagtttgctgcactgggggaaagggaagctgctccagaaaccagtagctgctttctacctctgggctctggggcattaacatatcccattgtgtcctgtttccaggagcctgactacggggccctgtatgagggacgcaaccctggcttctatgtagaggcaaaccctatgccaactttcaaggtacagctcaggcctctgggcataggaagctggggagggtccccagctgcttggggcttcatttctgtgttctgggccatctgtggtctttgtggagaagtggtggttgtggttttccgaggcccaagaggttgtgagagatgtgtggttggtgagcgaccgcaggtctcccagggccgacccactccctagcccctaccccttaagtcagcagtgaccctttaaactgctcctgtgggtgacccctgtttccttcctgggcagcagcggggtaggagctgggaggcacactggccactcattccccggcctcatggagccctgttacacaggttcttttttgttttgcctttttctctaaaaaggcctgggccctatttctcaccccctcccctccacagccaggggacctggaaggaagtttttctttccacttcacagatgagtggtagggtcccatccaggccccatatgcttccaggtcccggggaggcactcagggccactgcagaccctgccttcttggcctgccagccctgactcctgggagcggattcaaggttctccctgtggcccagggtggggcttaaggttccacctgggtcccgaggtatttcactggcagaggccctgcctctctgatcatatctgtcctggagcttccctgcagggcagtaacaagaactataactagggcctgttgatggcagtgtcatctcccactggcctgaccccaggcagggaagcccaagcacatgtgtgtgtgcacatgaagccccaggttggcagtggcagggagagcctttctgctctgactggtgcttctcacctctgcagtgtgcagtcaaagccctctttgactacaaggcccagagggaggacgagctgaccttcatcaagagcgccatcatccagaatgtggagaagcaagagggaggctggtaagccagtggtgtggtaggcccagagtccaagggccccagtggagctggggccccaaagacatgcatttgtgatgtgcttgtctcctgtgtgcaccagcagtgcctgcctcaccctggcttaggcatgggaacccctaccaaaggataccctcctcatgggagttcggggtggttgctggaggtcagcaccctgtggctcccacaggtggcgaggggactacggagggaagaagcagctgtggttcccatcaaactacgtggaagagatggtcaaccccgtggccctggagccggagagggaggtaagaccagaaccacctgagtaacagcattccctattcccagattctccttggcatgcccccatcacacagtcccaagcacgcacgtgcatgcacagacacctgtcacatgggctggtcgcacagcccatgtggccatgcacgtagtctcccatatacctgtgctacatttggcagtcacaggtacacccacaagatgtatttgtcccatgcacacggatatcccctcacacacatatgcagtagccatgctgaccattggtgggctttgcttcccacagcacttggacgagaacagccccctaggggacttgctgcggggggtcttggatgtgccggcttgtcagattggtgagctcccatctgtttctcttgcccactgttccctagggtgagattcttctttgtatctctttcctgctcctagggaggaagctgatggctgaaccccaaagtctgccctcactccaagctctccccatgctctggacatccccttgacaccctgggctccctttgtcactgtcagctttgacccctgcatgtttacctatgccaggcactggggaacccgtcagaatcagcagaacaaagttgatgctgctggttggctgacatccccaggcctaatgggttgtaccacagggatgtgacagaggcttggagatggggtggagagggagacacggcctgaggaagaagcatgagtcagagctgagttggaacactggctccaccacaaccagcagtgacttgtttgagttgtagcgtcgtcatctgtcaaatgggccagcagagtagtccttcccctcatggggtgtgggaaggaggaaatgggatgagatagaactcatttgagccagtgcctgcggtgtggagtggggtggagggggtgagatgtctattcccagctgttatctgctctcgccctcccagccatccgtcctgagggcaagaacaaccggctcttcgtcttctccatcagcatggcgtcggtggcccactggtccctggatgttgctgccgactcacaggaggagctgcaggactgggtgaaaaagatccgtgaagtggcccagacagcagacgccagggtgagattctgctggaaccttctggggggcagtgtgtgggcccgtcaggcagctgaggcctccagctcccagcacaggccccctcagagcagtggggcagccgatggcctatgctagataggccacagcccctgccttagctagggattgagaagaaacagacacataagatgcaatgtggtgtgtttaggttgtgttgagtttgagatactgatgggtcgttgaagtgggtctgcttagtgggcaattggatacacaagaccagaggtaagaggagaagtcctgggctggaagcaggagtggagtgggggctgaggcatagaagggatgaggtggtgtcgcataggaagagaacttgggatggattgagaagctccatatgagaaggcatgggcgaggaaaggagcccaggaaaggcaggtcagacagactgcaggccactggtgagggagagggtctgctgtgttgagagctacagaggtaaagacaggaacgataagaacttgcaagtgccctttggattcagcagcagctaatagcccttgtgagacttttgagctgcatcagcagcatggctggcattagatggcagtgggcagcagggagtctggaatggcaaaagcagagcctttgtagggcctgtccttgagggagagaacaggtgactggggtttgagcaggctctcatgcagatggctgaaaggagcgagcagcgtgtgggaggagatggagcccaagcttagctggtaggaccagccttctggagaaggtggcctcttcccctgagcctgggggaacagagaagtattctcaagggttagggaattcctacttggtggccctttcaccaagtgcatttggtagatgggtctgtagctgctttggagagggcacccgcaagccaaatagagaagggatagggtgcttgccaggctgtcccctagaaggaaaaggtgctggcataccaggtggttgaaggactggatctgggggtctaggctgaaaagggaagagtctgaatgtaagagccactgaggccgggcgtggtggctcacgcctgtaatcccagcactttgggaggccgagatgggcagatcacttgaggtcaggacttcgagaccagcctggccaatatggtgaaaccctgtctctactgaaaatacaaaaattagccgggcatgttggccggcacctgtaatcccagctactcgggaggctgaggcaggagaatcgcttgaacccgtgaggtggagattgcagtgagccgagatcacgccactgaactccagcctgggcgacagagcaagactctgtctcaaaaaaaaaaaaaaaaaaaaaaagccactgaaagaaagtcctccaggagaggatgggttggggtgcttgtaagtgggcttctgtagagatttggcatggagatttgccatgaagagtgggtggttatatttgagttgggggcgctgaggcagtgaggatcatccttaggacacagatggaaaccaagccaggggcctgtatccccagtgcagtcacaggtaacacagaagaatcatttttaccccagcatgaggctgggtaataaatggtcagaaagtgtcatttgggagtgtggccaattccaggatccctggaaggtcactgggaacatgggtggtgatgaggagtctgtatcccccaccccccctaagagggttggagggcaaatgtgtcctctgggacagaaaagaggaaagatgatttcaggatgaggctgaggacagagctccctcatttactgttgggtgtggtgtctggaaggtacaggggaaggtgggagaggggcccagagcacctgcagtgtgggcatgcccaaggttggcaggggcttccttctcctgggcagggctgtagcctggggctacagggccttgtgtgtgtcaccagctcactgaagggaagataatggaacggaggaagaagattgccctggagctctctgaacttgtcgtctactgccggcctgttccctttgatgaagagagtaagggccagggcccaggcggggtgtgcatgtgcctggagggcctggtgggtgcaaaaagagtatttaggtatccccccaacacttcctgggtgggcgggctctgtaagtgttttccctgtttggcccagagattggcacagaacgtgcttgctaccgggacatgtcatccttcccggaaaccaaggctgagaaatacgtgaacaaggccaaaggcaagaagttccttcagtacaatcgactgcagctctcccgcatctaccccaagggccagcgactggattcctccaactacgatcctttgcccatgtggatctgtggcagtcagcttgtggccctcaacttccagacccctggtgaggaagtcccctgtgaggagggtgaggaggggcactgtggggcagctggactggaatacaccataatctgcctcttccagacaagcctatgcagatgaaccaggccctcttcatgacgggcaggcactgtggctacgtgctgcagccaagcaccatgcgggatgaggccttcgacccctttgacaagagcagcctccgcgggctggagccatgtgccatctctattgaggtgggtgctgctcatctgggcttcagggtaggaaaggggctgcttgccgttggagtctgtttatgttgagttctccaaaagtaggtattttcaggcatcaaggtggtcagggtgggtggggcctgagctgagtctttgaaggggtgaagatagcatgcagtcactgtatgcatctaggacgtgcagagccatggtgtgacttgttctgatgacttgttttgttctgatgagatcttttttttccctaaggggaggtcatttaaaagatttctgtgttaaaatagtaatggatttaacatgaagtagattgcaaaactcacatggaaattttggctaaagctcagacttcagataaactacaggcagcagctgctctggacagcttagggtccctgatgtcgtgagggactccatgggcagtgtcccgggggcccagcagagggcgcgctgcctccactccacagatgctgactgagcctccgcagtggggaattggagggagcaggaaggacaatcccaggcccttctttgtctgcctacaggtgctgggggcccgacatctgccaaagaatggccgaggcattgtgtgtccttttgtggagattgaggtggctggagctgagtatgacagcaccaagcagaagacagagtttgtgggtcagtctgtcttcccagtcatcctcctcatcctgctggggcactgcaagcctctccccaccagtcatcccatcctctcccacggtgacctgaagccttttgtcgttgccttcacagtggacaatggactcaaccctgtatggccagccaagcccttccacttccagatcagtaaccctgaatttgcctttctgcgcttcgtggtgtatgaggaagacatgtttagtgaccagaatttcctggctcaggctactttcccagtaaaaggcctgaagacaggtgaggaccattcctggaggcagtgcccctgcaatcttgctggcagggtggggctgggccccttgctctgtccctcgtgggctgagggccaggcttttcctcctcctaggatacagagcagtgcctttgaagaacaactacagtgaggacctggagttggcctccctgctgatcaagattgacattttccctgccaaggtatctgcagcaggggtgggctggcctggggtaggtgggaggagagccaggcagcagcctctagaagtgcagaggagtcattgaccctcttgtgcacctggcttcgttgaagcaggagaatggtgacctcagtcccttcagtggtacgtccctgcgggagcggggctcagatgcctcaggccagctgtttcatggccgagcccgggaaggctcctttgaatcccgctaccagcagccgtttgaggacttccgcatctcccaggagcatctcgcagaccattttgacagtcgagaacgaaggtgaggaagatggaggggtgctagagccaggaaggcagtggctaggtcctccttcttcagtgtttctttctcctgggtagaaaagttgtaatattgtctggcattgggctgcaaggccctgcctgccagtaaggacactcttcccttctgtccagggccccaagaaggactcgggtcaatggagacaaccgcctctagttgtaccccagcctcgttggagagcagcaggtgctgtgcgccttgtagaatgccgcgaactgggttctttggaagcagccccctgtggcggccttccgggtctcgcagcctgaagcctggattccagcagtgaatgctagacagaaaccaagccattaatgagatgttattactgttttgggcctccatgccccagctctggatgaaggcaaaaactgtactgtgtttcgcattaagcacacacatctggccctgacttctggagatggatccttccatcttgtggggccaggaccatggccgaagccccttggagagagaggctgcctcagccagtggcacaggagactccaaggagctactgacattcctaagagtggaggaggaggaggagccttgctgggccagggaaacaaagtttacattgtcctgtagctttaaaaccacagctgggcagggtgagaagctagatgcccctgcagtttggccctggagccagggcagaggaatgtagggcctgcatggagaagggttctgccctgcctgaggaggaggacacagcacaagggcacattgcccatggctgggaacatgacccagcctgaaagatacaggggatcatgttaaaaatagcagtattatttttcgtctcaatggtattgtaactaagttatttactcctcctgctcctcacccctgtagggaaaccttggagaggagagtggcaggtgggctgcctgctgtgttaagaggacttagtttgtgatgtaaggcactgtcaggaatggggggcgggccagggtgggaagagaagaaatagcagagcctattttggtgaggttttttgtttttaagtcaaagaagactcagtatgctttccctgaggaatgaaaaagggattgaggagttgcctgactcctgggtgggtggggtacaggcagttaggtgctgaatgaagctgccatccttgctgcagcttctaactggtaaaaagatccagggatggagatgggaaggttagaaaggcagccctcacctctgaggacagaggccggggtccaggcccgtgggcgcaaaggtgcctcatagcatagccagcattcagcacacacaaacctactgcccacatttgggctcagggttggccatttgctagttctgctgccctcttaagatctgactgccaaataaatcatcctcatgtcctttttcctttgacttgtatgctctttcgggggctcaggaaagcctgttgcatgggacatgctcactagaaacagtcgccagatgattattctgcagtagaagcaggtaggaaatttctggaaatttctcaggttaagcagcaagagctgtaacccctcctctgggctaacaggagttgtgggtccactctctcctgcccaccctctgagggtgtgtctgagcagagtacatcctgcctgggttctttgtggccagccagttttggtggtgagctggaaacaaccagagcccctttccagttccacagaaacctctcctttcaaaaatgttgcattcagttcgttaacactgccaggtgccattctgattgcctctaggacttggcagctgaaatctctgggccctttcaacacagttgaaaggcccttctcttcctgaagctctgtttccatagttggctgtgctgggatggaacaaaaatgacgccacacaaaaaatttaagatagatccggttccgtggatgacatgaactgatgatagccagtatcaaacagcgatagtgctcaggttcttgtgtgactttcttttacagcttcacagtcccagttcatagagaggagggtggctttttcccatacacaagaaggtggtgggtgggaattcacctgggccctcatgatccatgtttcctctctaggtttttatggcctggagagaaaggtttcctatcagagaaggaagaggactgtgtaggcccttctgttagggcccatccacgttggttaggacgtccttggcgtgtttgttagtgttgacccttttagttttcatcaatacgtatctctatttgctgaacaagtgtctttctggaacacaacctggggaacagacagctctgcctttcttaaggcagctttgtagacctgaggctcacctctcttgggctctgtaagacattgcctttgcctcactgcaaatgttttgattgttcttcctagtggaaaacgtgccaactctcaagcaaatttaaagatcattttcacttcaagattcctccagacctgacaaatgttgattgacccagaaggcagagtgtttgttggtggggaagacccttacttggggccgaatgctttggcatcaggagttgtttgccccatcccatgcatgcaggccgtgtccctacagtgcgacagctcagggttatgacctgtggagtctcaaccctaacagcacattagcaccacttggggagcttctgaaaaatactggtacccggggccttagcataggtattgttcaaaacctctcaaggtgatttaaatgagtaacaagggttgaaaaaccctgattttggcagcacaaaccaaaagagcaggcagggccgggagagggaagtcagtggtaccagaaggtagatgggctcccttgcaggctccttgttctcctgccatcaccagtagaaccttctggctgacagaccagggacaagtagactgggttcaaagtgacagacctttcactttcaacagctttggctcagcagacatgtacacatacaaagtagagcctacaaggtcaggggcattctgcccccgccacaggactaaagactgccctgcgggaagatggcaggagcagtttctgacctcagttgagtatctgtggccatgagcagaaaaggcaggggtctgcctcctgaccaagcacatcttgaacatcacctgagagcttgaacatcactaaggacctagacactcacttgtctttcaacttgagcccatcactcaccatgtgagttctgttgagggtgggtagaaagcaaataggttcaggttatcccaccagactaactcggtgaatgaaaggatcatgccttcttcacattttaattaaatggatcaagcacagtctcagactgcaactcctgtcttctctgggtactttagtaattcccaggggacttgtgcttaggggttaatctaggcattctgttccctgcctggaggaaccccacagcaacccccctggctggccgctcctgcgaattccacccatagtatcccaagtgagtcactgcctgagtctacccactacagcattcagctgattggctttgccagttgcatgccagtttggtctagtttccaaggacctggtttttgggattcaacacacacagctgcttccccatgacataagctggactcctattctggtgtccagaatcactgcctggctccactgtaggtgatttcatttcaaaggaccctttttccttctgtcccaggccttcagggccaccccaacaaaattcaaatgctttgggtcttagaagctggggctttagtctttttcctccagaaagcccctgggtccttatgcatattccctaacccccgacaccgccccagcaaatgacaggctatgcttttcagcactctcacaggaaacagaaaagaacttgccagtgtcctctcaccagatgataccaggtttgactgtttgcctttgtctatttagcataatttctaaaatatcatagttttctcatgtagaagccagtgtggtgatctcagcaatgcagaagacagtgagttggaacttctctggtgagctgagggaaactgccccactcatccactggagtttaagatccacagaagtgggcaagaacaagtgaaatgtttttggcttttttcctgactcccccacaaaataagtcagcagatgtgaaatatatttatgtttttatttaggaataatcaaaaggtttgaagtaccattgaggcccatttcaaattgtacaagcaatttgtccgtgttcccctcccttatccaaatccacagatacaaaatctaggaaatgtgcaatttgcatcttagaaatagcagcatccccacaggggacctcgtgaggcctggagattcagccccaagagggcaaccccactcctgcctcagcacgaccacagtccaaaccgaagttaagttccatttttttgttaaaacgtttacccagggtaaagaattcccattctacccaaggcttaagtgatagagtatgctgttttctcggtttggtctctcacacctggccatggcaggagatgggaccctcttgcagagtttggctaaagtttcattgtgcctcaaaacaaacaaaaacagggcagttgcctcttacttgtttagcaccaagatgatcaccttttcagccatctctcctgacagcagactgctcaacagtcactccccagtcttattgcccagaagtccggccacagggaacaaggctttgtgctgaagaccaaaatgcaaatgggtgctagaaaaccaggaatcaagaccttgtcaggaggcatctacaggcctttggcaacctccctgacttccacaaaggctgccctcagtaaaactcaatgaacaatggccagcaggggagaaaggaaggtgggcgtgttttctctttaataacaattatggcacaatctgaccctcctaacacttctgaacaaagcaactgctcagaagcacagcgggaaccctctacacaggggtgactgcttctcccctggccccgacccagtctaaccgagaacaaccggattgctgtgctgggtccctgctgaggagtagggactggcgctcctcactcctgctgacaatctcatgtggggctctggccctgttccaagcaaactgcaagaacgagaccaaacagtatgggcaggaaccagggatgagtgacaagatctccctaaacaaattacaggattcataggtaccatgtagatttttcttttaaatgtatttctactcaggtttgattcttgggaaagaccaagcacttgtagctctctattcagtgactaaacaacctgacatttcacttttaactccagtcacattaagttttttttttttttttgagacggagtttcgctctgtcgcccaggctggagtgcagtggcacgatctcagctcactgcaacctccacctcccgggttcaagtgattctccttcctcagcctcctgagtagctgggattacaggcgcgcaccaccacgcccggctaatttttgtatttttagtagaaacggggtttcaccatgccgatcaggctggtctcgaactcctgacctcaggtgatccgcctcccttggcctcccaaagtgctgggattacaggtgtgagccactgcgcccagccaagtcacgttaattttgaatcatccacttacggaaaggaacagaagttaaaaagcattaaccaagaaaaactattcattaacacatacaggtgctcatgtgtgtgtgtgcacgcgcacatgaacacacgtttcaagccagtctcctgaaggaagaggcactaatggcaggtaaatgctcaggctcctctcagtaccctggggctcaccgcctatccaagtggacagcagggaaggtgcctagagtccccaccagagcggctgccttcctcccttcgctcagctgccagagcagccacgaaagccaaattctcagggctgtggaagctttggaccagcaacaacaagctagtacctatatgttctttatcatcctcaaagtcctgcgaacccaaagatagaactttcagaaattgaggaagggggtgctttcccctgtccttgtccatatggtaaccagggtctgcctagtctcatccccagcctctgggttccctcccctgctctagacttcagggcagttagaatggatgactctgctggatctagagctaaatagaaacttctttgccatagaaacttctctgttgaaggactgcgtccccattcaaagaggtcagatttgtgggcaggcaagagctcaggaatgaagaaccaaaaaggaggctctcaacccctctccaaggccagacgctctctgtactcccattaacttcacaaccaagtgcagacgctcggtgagttcagagaccacttggttagccctgccccacccctcctggtgtgacctggcactgggaacacacagattgcagcagaaacctgttggttccatttgcactcagagcaaaccaagcagcaccttgattgccacttttcctccagccactctgtcaaaatcaaaactggttgcctcaccagccctggtgtggcatggcccaaccatgtccctgccgccccacttaaatggccagagaaaactacatggtgggtagatgaggttgaagccttgcttggggaagggacttgagcacaggagaaaggcttgagctccacaactgcccatttgctcagacaatggagcttttctgagatcaagtgctccccaaactacatgggagtagccccccgtggtctgggcaggctggctgagagaggtctgtgctctcaggtaaaaggagagaaggaagctgggtcaagagaccctgaagaggagggtccgtgtctggagtgaggggaactgagccctgctggctacctgacctgggtgggctgctggctttgccctggaagacttgactatgtgggccttcatgtgtctagaggatttttcttctccagcatataactaccttgagaatggatgtgatatgtgaaaatttaaatttaatacaaaagcacatctgcaaatggtgagtcaaactggtgaaatctcccaggtaaactctgagcaagaaaaaagagaagatgactttaggaaaatcctaaacgaggtttggttttaaaattttcttcttggctggctctcctctcctgcaagttgcctttatccacttggggtgtgatatctgaactgaaaaagctgcaccaatctgaggatattggtccaaaaagagacaagagaccacgaggctcaagcagagagcatccacacagcatccaaccagaaaggccagtgtccttcctccatgaaaggcagccagggacagatgtcccagagccaggagagagagggagagaacacaggacctgcccctaggccactgactgagcaggataaaacccacaagggcacatctcaggctacggaatagagagatttcctggtgggacggcctcccaaggctagctggagatgagaccactagtacatgtgtgagcccgcaaggcactacccaatgttctgtccaacttcctccttgtgctactagagagcacagtgtggagtccttgtgtcaaggtgctttggtccacctgaacagccacctgtcactcagccaagagaaaggagctttaagttgtacaatcactaccaaaccccaaggccctggcaagccatccaactagggcgttctttttcaggaacccaagattctcaaaaatgacactcctcccctcccaaaataaaaaagctcctttatagtcaaaaacgaaaacaagtaatcaaaatatacaaagcatatgtatcaaatttaaatttcctttatcagaatgatcatctggtttcacctttgagaactcgatctacaaccccatgtaaaaaacaaatgggtacaagacatcagcaacaaaaaaacactaaaagatgattttactatctctgacgagtccaactgcatacagagaaaagggataagattagccactttttataggctttttcttcaggagagactaacctcacccaactctcaactctgcagcccacaaatgccttctactgaaggcaacaacacaatttaacccttaggcagtgtgcaaaaccacagtgagctgtcctgtgacagggctacatacctggctgctgccatcccacatcccccactgccactgggctagtgtgggtgtgtctctgtgcacgactggctggattcagggttttgcccccaaacccttgagtacctcctacaatgtccctttaagcacctgcgtgatgactgcctccctcatcatcgcttttgatcatctttcaaggataaggtccagagcatactcactcactctcatccaacagcagaggaagaaggatctgtccagactgctgggctccttacatgggcattcttgccttttgtagtgtagccctggctgttgggcagggctaacatctataagaaaaacataccagggcaggcagcactgtacttttccacctgaaagatgagctagtgcccatggctgggtcactgtaggtcctgcatgaacttgtccaccaactgtgttttgctgtttgggttgtaaattaaccgtgaatacaagtaaccaagaaaatcctctccacagaccaactcttcagccagtgcatgcagggctctggaggtgatgccagcaggatctggaggtgaggcactgggtggtttctcagacacccggagatggcttcagcctgggccgccccagctgcctagtgcactggtgtccctccaacacaggctactcccccaacacccatgtgccaccaagtttctcaactgcacacgccagatgcgcgttttacgagaatcaaatgagtatttatactgtatatgtgtgtgtgtatatatatatatataaattaatctgcacgtatataaacactaaaaggagaaattccaagtgtctgttctctgaaggaaagcaatcactcgccattcttggcaattcctcaaaggtttttgagaccaaacatctttactccccaaattaagaatacaaaaataggctgcaaaacttgccaagtactcacaagtccctgtttgagacaaataagatgtggtccctattgggacagggagggcagaagatgacactttagaagaacatgattttggtttcaaaagcaagacctctcctggaaggcagaaggggccaccgccatgcttgtccttggagccacatgagcacggtgccctgccaggtccagttccctgggtaggggagaaggacggtccctaaaacaccaccagtgcttcttgcccaaagcccttgccctctctctggggtcttctagcactgtcactctgcccagcccaggaggtgtctgtgcccacgaagcctggtacttgtggcttggcactctgggaagcaggtggtttctaagaaatgagcggagctacaggtggacaggtctttagttcgcccctctttaccagctactctcagagcaaccggtcttggggaaattgaggatttaccatttagaacagctctgtaagcaagttttctaattttcaaaggcaccatttcctgtaattttctcaattcaaaaaaggacatgagggttaggctaaagtagagttcttgtttccaagtttggggacataaatataaaactttaaaagcatcctcacaaggaccagtgatgcccagcacccttgggcatgcatccagcacaccggccagaccctggggtgggagccacgggcactctgggtgttctgccagggatctctgcatgcaagtctttgtgctaaagaccaccctacctctgataattccaagaagtcaacaaatccctccagccttcacccttactaatgggccagtgtgttattccttcccaaaccataggaggctctgaaatgagtgtggagaaagggctctgaaaaccgcagtggtcaaagcttcaggctgtggctatagatttccacttacgtccctaccccatgtcttttttccatctttctctcactccaaacatgtctagattaaaaaaaaaatgcaggcacataggtcagcacattaggcttaacaacaaatgtttctttagttgatctgataactgaaaagttatggtccatgattcaaactcccatgaaaaagcagaattacggtaacaactaaagagaatggtaaagcatccaacgctaatcacattgccagtccattttttgaactgagggttacagcaggttctgcactgagtagcccacaaggcaaagcaagcctgacatgaaacgtagccggtcatcacttaatgcagcagagatctcttcaaaggtactgcttccttgaggaacacaaagggggcacaaaggggttccagacgtagctttgtgcctataacttccctgcctgactgtggaaggtgaggggcacctgtgacccagcaatccccagagaacagacacaggtcatttttagagatgacgtaactgacaatgcactgcttggctaaccaaagtttctacgtaatgacagtgttgataatctgatgttttatttaacatatagaggtggatgtatatgttaaaagcttgattctgtgtctatgaatatgactatgaactctgaactattttatccattggaaggtaaaggaaaggtcctacattgtgggaggaagaactgatgagaaccccatcttgcttgctgcttgcttggtggtgggcaggccgagggtagcggcaggctctgggctgtctgcgaggattctggaagctctcccaggtgcccagcagccgggcatgggaacggcatgtggcagcagagagtcgggtttggctcttccacgtggcaggcggtttcccagactggccagtccttcacattaatcagatcaaattcagtctgtttctgagaagaaaacacatgcctgtcactctacggcagctgccaccacctgccccccaggcagcctggtccttgctataccagggtggcatcactggctttgaggacctcttaattccatgagcaatgaatggccttctgccacccactcccccaccctccagcctgagggaatgtgggttaaggacaggatgctggctcaaccttgtaaggccatcagactctctgagagaccctgctaaaccctaggcctagcagcaggagcagtggtttggcctctccaggcccactaaatccccctagctccccaggcttccgccaccaccgtctctggagtcctgtcctaaaatgcttcatcctgccctctccttccaggctctccagaacatactgttccaatataatagcagctgggtctagttctgatatgtattctactgatgtcttcacttcatttgtaacttgcaaccctaacatcaaagtcaaagtaaggctgatatcagagaggttcatcatctgtgattcataaagaaatggtccttaattgcagctggctgagaaagccatgagaaaccaggtacagataaacagattggcccttcctgtacccacagttacctgtctcagacagaagagaacaatgccaatggcaatggccaccccctgccattcctgctctgtcccacaaaggacagcaacatgtcactttgtgttggatttagtagctgaggggagccaatgcttgtcattcaaatccactcatcacatttccatgttgactttaagaaaaaaaccatggtaaaatataaataacataaaattcaccattacgacaattttaagtgtacaattcagtagcattaagtacatttacaatgttataaaaccatcactctatttccagcaatttttcatcatcctaaacagaaattatatatccattaaacaacaactccccatgtcctccaccccttaggccctggtaacctctattttaccttctatcgctatgcctttgcctattttagatacctcatgtaagttgaatggtacaatatttgtctttttgtgtcttgacatctcacttagcaaaaatgttttcaaggtccatccatgttgtaggatatatcagaattttattccttttttggctgaataatatcttactgtatgtacacacacattttctttatttatctggtggtaagtacttgtttccgccttttggctactgtgaataatgccactaagaacactgatgtacatgcatatgtgagtccctgttttcagtccttggggcgtatacctaggagtgaaattgctggatcacatggtaatattctatattcaccttcttgaagaaccacaaagtcgtttcccaaggagctgtaccattttatattcccaccagcaatgcacaagggatccagtttctccacatcctcccaacacgttgttttctctgggtgtgtgtttgtaacagccatcttaagtgtgaagtggtatcacgctgtggttttgatttgcatttccctaatgccaaaggttcgtcttttcatgtacttattggccatttgtatattttcctatgagaaatgtctaaatcatttgcccgtttttgaattggttttgttgttcagttttaggagttctatacatattctgaatataaatctcttatcagatgtatgattttcagctcttttctcccattctgtgggttctttcattcttttaacagtgttctttgaaacacaaaagttttagattttgacgtaatccaaattattattttcttttgttgcctatgctttgagtgtcatacataagaaatcattgcctggccagatggggtggcttgcacctgtaatctcagcactttgggaggttggggaggaatgcttgaagtcaggagttcaagaccagcctgggcaacatagcaagatcctgtctacacacacacccacacacaaaatagtaataataaaattagccaggtgtgcacacttgtaatcctagctactcaggaggctaaggtgggatgactgcttgagcccaggagtttgaaactgcagtaggtttgattgtaccactgcactccagcaacagagcaagaacctgtctcaaaaaaaaaaaaaaaaaaaaaaaagtaataattgcctaatcaaaaatctggaaggattctattttcttctaagtattttatagctttagctttttttagttctttgatctattttaagtaaatttctgtatatagtacaaggtaagagtataatttcatacttttgcatgtatatatccagtttcccagcaccttttggtgaaaagactgtcttttcccattgaatggtctttgcacccctgtcaaaaatcaattgaccattacgtggggatttctgggctttttattttattccattggttttgtatgtctctccttatgccagtaccacactgttttgattactgtagctttgtagtacaatttgaaatcaagtgagtgtgactccttcaactttgttttttctcagtttgtctatttggggtcccctgagattctatataaactttaggatggattattcttttataattgatagtttacatatttatggggtacatgtgaatattttttacatgcacagaatgtgtaatgatcaagtcagcatatttagggtatccatcaccttagtatttattatttctgtgtgttggtaatatttcaagtcctctattctagctactttgaaatatacaatatgttgttgctaaccatagtcacactagtctgctatttaacattagactttgtttcttctatctactataagtctatacccatttaccaacctcttttcatttcccccttctactctcacacccttcccaacctgtgctatctatcattctattctctatctccatgaaatcaagatttttagctgccacatatgagtaagaacgtgtatttgtctttctgtgcctgggatattccaatgaacataatgacctccagttctattattttttgtctttttaataatagccattctaactgggataaaatgacatctcattgtggttttgatttgtatttcccttttgatttgtgatgttgagtgttctttaatatacctattggccatgtgtatgtcttcttttgtgaattgtctattcatgtcttttgtccccccacccacccccaccttttttttttttttttggacacaggatctcgctctgtaacccaggctctggaatgcagtggcacaaccacggctcactgcagtctcaacctcctgggctcaactgatccccccacttcagcctcctgagtagctgggactacaggtatgtgccactacacccgactaatttttgtagagatggggtttcaccatgttgcccaggctggtctcaaactcctgggctcaagtgatccacctacctcggcctcccaaagtgttgggattataggtgttagcctctgtgccccaccttttgcccactttttaatatgattttttgttgaattccttatatattctagatattagtcctttgttggatgaatagttttgcaaatattttctcccactcaacatattgtctctgtgctgattatttcctttgctatgcagaagatttttaatatagttccctttgtctatttttgttttagttgtgtttttgaggtcttagccataaaatcgttgctcagaccaatgtcctgaagtgttctgcactgttttcttctagtagtttcataattcaaggtcttatatttaaatctttaatctgtcttaacttttgtatatggtgagagatacaggtccagttttattcttttgcttatggatatctaattttcccagcatcatttattgaagagggtgtcctttcctcattgcatgttcttggcacctttgttgaaaatcagctggctgtaaatatgtggctttatttctgggttctattttcttttcctttggtctgtgggtctatttttataccaataccatgttgttttggttactatagccttgtgatatattttgaagtcaggtaatgtgatgcctacagctttgttctttttgcttaggattgctttgactattttagctctttcgtggttctgtacaaattttagggtttttttctactcctgtgaaaaaatcacattggtattttgatagcaattgcattgaatctgtagattgctttggacagtgtggccattttaatattaatttttccaatccataagcttgggatgtctttccatttgtgtcctcttcagtttctttcatcagtgttttacagttttccttgcagagatctttcacttccttgattaaatttattcgtaagtatctttttttatttttggtagctattgtaaatcagattaccttcttgatttctttttcagctattttattattggtgtatagaaactctgatttttgtacgttaactttatatcctgccactgtgctgaatttgcttaccagctttaagagttttggtggagcatttttggtttttctaagtatcagatcatgtcatctgcaaaaagggacaatttttctcttttccaatttggatgccttttctttctcttgcctgatttctctggctagaacttccagtactatgctgaataggagcggtgaaagtgggcatccttgtcatgttccagttttcagaagaaggattttcagcttttccccattcagtatgatgctagctgtgggtttatttatggcctttactatcttctttctatgcagttttctgagtgttttttttttatcatgaagcaatgttgaattttatcaaatgctttttctgtttattgagatgaccacacgatttttgctcttcattctgttgatgtgatgtattgcattaactgaatggtgtatgttaaaccatccttgcattataattttttgagacagagtttcgctcttgtagcccaggcggaagcacaggggtgcaatcttgtagcccaggtggaagcacaggggtgcaatctcggctcactgcaacctctgcttcctgggttcaagcaattctcctgcctcagcctcctgagtagctaggattacaggcatgtgccaccatgcctggctaattttgtatttttagagatagggtttcaccatgttggccaggctggtctcaagctcctgacctcaggtgatctgcccaccttgacctcccaaagtgctggaattacaggcatgagccaccatgcccagccaaggattattgatatgtgaggttttgttattgttatactgttgttttctagttgttttatatatttttttcctttttcttttgtttggcattgtactctggtagttttctgtagtggtagcatttgagtcttttcctcatctgtgtgtttgctttgccagtgagttttatacttttgtgtgttttacatagtgttaaatgtcatgttttcacttccatgtttaggactcttgtgagcatttcttgtagggccagtctagtggtgatcaattctctcagcttttgcctgtcttggaaatactttatttctccttcatttatgaaggataattttgctagacatagtatccttggcttactttttttccccttcagccctgtcaacatattatctcattttctcctgatctgtaaggtttctgctgaaatccactgttagtctgatggggcttcctttatagttgcttacacacatttctcttgctgtccttagaattatctgactttagagagtctgactataatgtgccatagagaatacctttttgcactgtatccatttagaggctatcagggcctcctatatctagatgtctaaatctcttgtgagatttgggaagttttcacctattaatattatttcattaaataggttttctcactctttcattttctcttaaccctctgggatcccaataatttagatatgtagttgctttattgtgtcccatatgtcacaaaggctttgctcattttttattcttttttatttctgagttatgtcaaaagacctgtgttctagctctaagacttttttttctgcttgatctaatatattgttgaagctttcaattgtattctgtactttgtttcatgaagtcttctattccagcatttgcttttttatgacatatatctctttgataaaattatcattcatttcccaaattgtttttctttttcacattctcttacatctcattgagcttccttacactcaataatttgaattctttttctgggattttgtgagtttattttttattggaatctattgcaggaaatttattgtgttccttctgaggtgtcatatttccttgctttttcatgtttgtgtccttatgttgatatctgcacatctggtgtaacagttgtttcttctaattttttgcatttgcatttgtaagggaggactttttcctagacgtatctatggtgttgtttgggtaggacactttggctttgattcttggtatgtgcagtagtgtagtctctgtatgatttctttggctataaatagcatcagtggtatctgtgatttcctcagtggctgagtagttactagtggaagctatggtaaaattttgctaaggactggaatgccaggtgggccattctccaggcaccagtggtagcagcagtggacagagcatgcctgtctttggacctcagaggagcatacaatggcaccagtgttagtgggttcaagcaggctgattcttgggctttcgggtggcttactcagatgtcagtagtggcagcagttcccaggcatgtgatcaggttctcaggcccctgggcagctggcgtggcatgggagatggcagtgacagtgttgaaatgaccctctgggtcccaagtgatatgtgcttgtgttggcagtggctgcaacaggctgggcggcccattctgcaggcccacaagtggtacatacaggtagtagtggccaagtgggtaagccccaacctcaggtacccaagaggagtattcaagtgccaatggtggtggactaggctggacaatcccccagcccctagactgtgtgctctggccacggaggtggtggtgtaaagccaggctgggcagtctcatcttcaggctccctatgatgtgtgcaggtgccaaccaaggtgggcaggtgcagggcaatccctaggccaccttcagaatgcttggatagggagtggcagtgctgtactactaccttccattggagagcacagggttgctggccagtggggaatgcatgtgccactcacacctcactcagctccagtggcacttgtgcctcagcccctgctatggtagctggcaccatagttgtacctcagccacaacaacaggagcacatgccttgtagtgcttcagccccagctgcagtaacccagtcacttatgcctcagctctggggaaaacagtctgcagttctcttacacctcagccctggcactcagggactccaggacagtgtacagtcttttggggggtgggctttaaatggcatcttgctgtagctgttttgttctcaggaagtgtgggggacccagtgcgagctccgttctggagcagttccattgaacaatctcctggcacctcctatgttaagtttcagggactgcaagggctgaggagctctcccgtggctagaactgcagaatcctttcatggtggaaatgtggaccactgagggtctctcacttaccttttccccatgctggggggtctctctcagttcccagccaatcccagctgaacaggctgccttgcttctttttccttccttactttgtttcctgtctcttttccgtgaattccagtgttctgtcttggataatctattcaaagtgtgattatctactctctatttttgttcttaatggaagaggcgagtacaaaatgcctctagtcagccattttggttgggtcttcctggattttcttatttctgtaaaaatgcgactatgcttttgatagattttacattgactctgtagtttgctttgggtcacgtctacatcttaatatcaatccatgaacatgggatatctttctatttatttaggttatctttaatgtttttcagcaacattttgttgttttcaagatacacttctttggcctccttggttaaatgtattcctaagcactttttctttttgatgcccttgtaaatgataccatttttaaaattttcttttcagattgttcattgcaagtgtataaaaatacgaccaatttttttagacagatagggtctcactatgttgcccaggctggcctccttgaattcctgcctcagcctcccaagtagtgggactacagttatgtcactgtgcccagctaaatacaaatgattttttttgtttttatatcctgcagctttgccaagttcatttattagctcttaactatttttgtgtgtgtgtggattcaagttttttttttgttgttgttgttgtttttgttttttttttttgagaaggagtctcgctctgtcaccaggctggagtgcagtggcatgatctcggctcactgcaagctctgcctgccaggctcaagtgattctcctgcctcagccctaaccctgagactaaaggcacatgccaccatgcccagctaattttgtatttttagtagagacggggtttcatcatgttggccagggtggtctcgatctcttgaccttgtgatccacctgccttggcctctcaaagtgctgggattacaggcgtgagctaccacaactggcctcaagtttctacatatatgatcatgtcatctgtgaacaaagataattttacttcttcctttcgaacttggatccttttatttattttttttgcctaactgctctggctagaacttccaatgctgttttgaatagatgtggcaaaactgggcatctttattttattcctgatctcaggggaaaagttttcggtctttccccattgttgagtatgatgttaattgtgggcttttcatatatggtcttcatcatattgtcatattcctagttactgagtgtttattgtcatgaaagcaagttgacttgttagatgctctttctgcttgaattaggatgatgtgttttattctctttattcttgtaatgtggtgaattacattgatattcatgtgccaggcaatccttgcattgcagggatagatccctcttgctcatgaggtataatccttttagtatgctgctgaatttggcttgctattttgttggggatttttgtatctatattcataagagatattagtctgtagatttcttttcttgtagtgcccttgtcttgctctggtgtcagggtaatggtgacctcatgagttaagaagtgtttactcctcttcaatttttttggaggagtttgaggagaactggtgtgttaattcttctttcaatatttggaagaattcaccaggggtcctagacttgtcactgttggaatgtttctgataacaatcttcttaccagttattgatatattttggttttttatttatttgtcagttgattttgggagagtgcgggtttctaggaatttcatctaggttacccaatttattggcacataactgttaatagtagtctcttataatatcatattcatgtgaaaatatcttatattcatgtgaaaatgtaacatcccctctttcctttctgatgttagtaatttaagtcttctctttcattcttatttaaaggtttgtcaattttgttttttcaagaaccaacttttggtttcattgattctctatatctgctctaacctttatttccttccttctggtaactttgggtttcatttgctcttttctagttctttaaagtgtacatttagtttactgatttgagatcttaaaaaaagtttttttaagacatggggtcttacgctgtcacccaggctggaatgcagtggtgcaagtatagctcactataacctcaaactcctggtaaacaatcctcccaccccagacacctgagtagctggcactacaggaacatgccaccacacctggcttattttttacttttttgtagagacaggatcccactttgttacccaggcaggtctcaaactcctggcctcaagtgatcctcctgccttggcctcccaaagcactgggattatagatgcaagccaccatgctcgactgagattttttattttttgagaaggagtttcgctcttgttgcccaggctggagtgcaatggtgcggtctcagttcactgcaacctctgcctcctgggttcaaattattctcctgcctcagcctcccaagtagctgggattacaggtgcctgccaccatgtccacctaatttttgtatttttagtagagacagggtttcactatgttggccaggctggtctcgaactcctgacctcaggtgatccacccaccttagcctcccaaagtgtggggattacaggcataagccactgcgcccagcgtaagttctcttttaatgtatgcatttacagctacagatttacctcttaggattgctttcactatgtgtcataagttctggtatgctgtgttttcatttgtctcaaggtattttttactttcccttatgatttctttgacccattagtttttaaatagtgtgttaatttccacctatttgtgtatttccacttttttattttcaatgtctagtttcattccactgtaactggaatgtactctgtataatctcagtttttaaaaatgtattaacacttgtttcatggcttaacatacggtttatcctggagagtattccatgtgaatttgagaagactgtgtattctgctgttgttgggtggtattctgcttatgtctatttggtctaatttgcttagagtgttgttgaaatcctctatttcctgattgatcttctgtctggtttctatatccattatcggacatggaatattaaagtctccaactatttttgtctttctccctttaattctgtcatttctgtttcatatgttttggagctctgttaggggtatatatatatataatatatataaataaatatataaaaataaatatatatttataataaatatatttttatttcatatataaatatatatcttataaatatatatatttatataacataaatatatatttatatatattatatattatatataatatatatttatataaatatatatattatatataatatatttatatataatatatatttatatattataaatatatattatatattataaatatatattatatattatatattatataaatattatatataatatatattatatataatatatataaaaatatatatatttatatatataaatattttatcaatataatatccttgtctcttgtaacctttcttgatttaacatttattttgtgtgcctttttcaaaagaggacactggaggtgaagaaggaagctcttgactctcctaaagctgatcccaaagtgaaggctttgaaggccaagaaggcagtgctgaaaggcatccacacagccaccaagaaaaaaaaaaaaaagattcacacatcacccaccttcctgtggcccaagacattatgactctgaagacagcctcaatatcctcagaagagcactaccaggagaaataagcttgaccactatgccatcatcaagttcccaataaccagtgaccactgagtctgatgtgaattagatagaagacaacaatacacctgtgttcactgtggatgttaaaagccaaaaagtaccaggtcaggctgtgaagcagctctatgacactgatgtggtcaaagtcaacacattgatcagggctgatggagagaagaaggcgtatgttcaactggctcctgattacaatgcttctgaggttgccaacaaaactgggatcatcttggctgagtcttgctggctaattctaaattatatatatataacatgttatacatatattttatatataattgtatatatttaaaatacatatatattttatatataattgtatatatttaaaatacatatatattttatatataattgtatatatttaaaatacatatatattttatatataattgtatatatttaaaatatatattttatatataattgtatatattttaaatatattttatatataattgtatatatttaaaatatatatattttttttctccagaaaaaacagattattttgtctggtgataatatagccacctcagctgtcatatggttactattttctaggtgtatctttttctatccttttactttcaacctccttgtgtccttatatctaacatgagtctcttaagacagcatataaacactatttgtttaactccaatctgccaatctttgtttttaatagaagagcttaatccctttacatttaatgtgattacagatcaaggatttacttctgccatttggctatttgtttttaatatgtcttatatgtttttgattcctcaattccattactacctccttttgtatttatttgattgttcacaatgtactgttttgattctgtttttacaatgcactaatttgttagttttactatttagacagattacatcttacattctatgcccattaatatagatttataattttttaatgaatttgtcttttaaattataaagcacaaagagaaaaagttataaaccaaaagtacaatagtactggctcttatatttacctctaaagttatcttaactagtgctctttttttttttttttttttttgtgatggagtcttgctctgccccacccaggctggagtacagtggtgcgatctcggctcactgcaagctctgcctcccaggttcaagcgattctcctgcctcagcctcccaagtagctgggattagcaccaccaggcccagctaagttttgtattttttgtagagatgggttttcaccatgttggccaggctggtctcaaactcctgacctcgtgatccacccgcctcggcctcccaaagtgctgggattacaggtgtgagccacggcacctggcctattttttcttatggcttcaagtttctgttcagtatcctttcatttcagcatgaaggactccctttagcatttctggtagggcatgtctactaataatgatctccttcaattttatttggaaatgtctggatttctctttcatttttgaagaatagttttgccatatacagaaatcttggtttagaggttttttttttttctttttttcacgactttagatatgtcatctcactgcctttgggcttccaagatttttgatgaggaatcggctgttaatcttgtcaaaaattctgtgtgacgagttgcttctctcttgctgctttcaaaatcctgtcttcaggttttgacaatcctaatataacatgtcttggtgtggatctgagttcatcctgcttggattttattgagctttttggatgtgtagattcatgtctttcatcagatttgggaaattttctatcattatttctttaaatattctttctgtcccttttctttttctgcgattcctatatgagtatatgagtatgaatatactaatgaatataataactatatgaatatatgagtacattagtatgcttgatgatgtctcacagctctctcaggttttttttcctaaatattttttttctttcttctcctttggataatttcaattattttctcttcaaattcactgttctcttcttttgcatgcccaaatctttgttgaatccctctagtgggttttccatttcagggattatactttttagctctagaatttgtttggttcctttttataatttctatctctttattgatattctcattttgttcatgcatggttttcctgatttcctttagttcttcgtccatgttttcctttagctcgctgaacatacttaagatagttgatttaatgtctttgggtaataattccaatgtctggacttcctcaaggatggtgcctgtcaattttttttcctgtgaatggaccatggttttctatttctttttatgttttgtaattttttgttgagaactggacattatgagtattacattgtggtaactgagaatctaattctgtcatgcctcagagattgctgatttttgcttattgagggctggagccaactatttgtgacttttccaactatttttgtgaagtgtgtattctttgcagtatggggtcagtgaagtttctgttgtgatatctctgtggttaaccagtgacctaagatttccttaaatatctggcttgccaaaaggaggaataaagaaaaaaaaaaataggtactgtctctttaaatccccttgtggctagaaagctccctctgcccaagggcattgagacaatgatcagcctctgcactggccccctcagtgattaaatgcagtaatcagaaatcaaaaaactcttttttttttttttttgcaatggagcctcactctgttgcccaggctggaacgcagtggtgtcatcttggctcactgcaacttctgcctcccaggttcaagtgattctcctgcctcagcctcccaaatagctgggattacaggcactcaccaacatgcctggctaatttttgtatttttaatagagacagggttttaccatgttggccaggctggcctcaaactcctgacctcaagtgatccacacctcagcctcccaaagtgctgggattacaggtgtgagccaccacacctggccacaaaaacttgacttttggaggacaaagttgttattgcctaccctggcaccaacagtctgcaccaggaacattttccacagttgcctgctgcagagcttgcggatgctgaaacaaaaaaaaaccatcaaaatttgtaagcctctccatcaagctcttccctggatgttgcaagtgttcaactagacttctgagtcccaaaacagttgcttgagacaattactgccagctcaactgctttggtggaggaaaagattcctggtgctgctactgccatcttccataacatcattctccatgtcagctttcgtaatcaacttgttcaaacatcctcatctctcttgagcatgacaccctggcctactggtatattacaagaagcacagagctgggtataatataaggaccaacttacaaacttggacaaagacttgtaggagagactacctgctctgcattataaaaaagttaaactagccataaaaacctgttgttctgactccagggtgtgccatcagctactttataaagcaggctgtgagctgtgggccccaaaggaggggagtgttttgttgttgccgtattgaaaacatggctggagttggaggaggctgtaagggagccagtggcccttgtactcctaccctaagtgctgaccagggctttgggctccaccaggtgtttgctctcactgtgggctttgtggaactggattttgccttagtatgttaatatgagaagaacaggctttctgcaaatgctaaacagatggatgacatggtactccccgcccccaacccaccaaattatgggccaaaaaggaagtctctttttccttaattcagtaaagaaacaatagcataactatgtttcaaactgttgtgttcaaatgaatttaaaatattcagagaaagaaaaagaattttgtcctttttaagacatcctaagtagaaagcaactggggtggaggagctgggatttgccaggccaaaataaacaaacaacaatggttggctattgtatggaaacaatgcaacaccatccaggaaattctgtgggatttctgagggataggccactatggttggccctggggatgaggtaccaaacacaaggccccacactgaggcagctcatgccaaagtcaccacggaaccatcacattgcccaacaccacaaatagtgtctcctgtaccccctcccacattgccaactcagctagcaatgctgccattttggaacccccaatcccttcagcttctacaatactccgccctcctggctctcacctgagcttctggctgccctctgatggggtctctaatgagaacacaaatgtcaaagggtaaggagggaagggagaggctgggaactcagtgaccaggaacctagaaaatcaacacgtaataacatgacttgtctgtggcttcaaaactatgtcttaaataaaaataatcttctatgatacattttgctttcgagtacaatccagagaaactgaggaacaaaattcaagcttttgattccatgtatgtcaaagaaggaaggtgattttccattatactaaacatttcttctacatcaggcataaccagagaaacacaagactttcatcatcagaaaaaagcacattatgtatctaaggacaattaaaggctctctttccttttcatcaatttgagctgaatttcaactcatgtcctgttgctgtctcctacccagtggctgtggatctgcccgactcagaggatgttttgacctgttctcctattgctaagaaatggctagaaaagcttggacccctttagggtcaccatgttccttcccctgcgcaggtttttaaaaacacatgaaacaaaaaacagctctcaaccgtttatcatattatattcctatggcttctgctgctagttgtcctctgaagcagccaggcggttaatgctgctgccaggcagccttagagacagcagatgcccctgtgcagtaaattcagtgcccaaccataagtgcctcctccccttacccacacaggatagccatggcccctgtggactccttaccgagctgacgtccagcctggggactcgatgtgtcaaagggctctgagctggcctcagggacacggggctcccacgactcactgttctcagacacctctgaataggtgtcacccatccctttgtgaactgctgtgagctcaccagtaccagggccctggtcctcactgcctgtgtctgccacggctctggtctcctcccccattttctcagcaaaccactgcttgacctgctgggagctcatctgggtcttgtcacagaggttctgcaggtcctcttcatacagcatcttgtgtgtcatgtaatagtcctgcaggagctcccggttgccaggggcaatgaccagtagccctggtgggaagttgcctcgcttatagtcttcgtaccatttgagttggccgttcttcagtgcgtacctgctatctccaaaccagcgcaccacctctggccgtggcagacccgtctgggccatgatggagtcatagtcctggttgcttggccactgtgtctggacaaagagctgccgcagcaagtgccgctgctgggcagtctttttgcagctcactttgcctgggagctgctctgccagtttgtttgactcatcatcctcagggtcacaggcacccagccctggaatctcgttcctgccattggcttcagtgaccctcaggttcttcaggttgattttaatggggctgactttgcgctctgccaagatatggctgctgggcatttccagagagccattttcaccagagacccttagctcactggccaaatcctcttctccaccctcatcctcagcagcctcctcttcctcctgagaggcattctcctcagccttcttggtctcctcagcattcacttttttccgtctctctgaaaaccagctatcaatttctcgtcgggtcattttggtttcacttctcaggcggtccagttcctcatcaagaggaagagggttttgtgcaaaactgctctccagggctctgagctgctcaggggctctctccttgtatttggttggtgtgaagtcaggagtctggtgccaagattgtcgtttggcagaagggtgggttgctagtgtggctgttgtcggaatgcaggttacctcagggaccttggacgatggggagaaggacacctctggcacagagtcaatgatgatggaactgtgatctccaggtatcatcgctctggagcccttcaagttccggcagtggtatctacgatcactgaaccatttccgcacctctctggtactgaggcccgtcacttttgtgagatgttcaacttcgctctgccctgggaactggttccgacagaagctccctttcagagctgacagctgttcatgagatttcttatttttgtagatgctagcatcaaggaaggcttgggaggttatgctggggcaggccgtgaggagcgactgggccgcattgaccaccttcacagctgacgttgtatttgaacacacagtgttaatgggtgccacacctggctgcttggggacggatgtcaccgtgagggggagaggggaacttgttgcttgcaacccattggccatcaatggctgagtgaccagaagtccccctcctgtaccctctggctgccccacaacgtgacctggaagagcggcctggatgagatgctggacattgccagcactggcgacgagtggggtatttagaaccgtaattgtgggctgaggcacagactggatgactgtattgaacatctttttccgggcatcctcaatctcctcaggggaccagctgatcccctgcttcagcctttgggctgtgaaccagatcttgagctgttcttctggatacttggtcaccacagtcaaatagcagagctcggctttggtggggtaggggaacttgtggaaggagttcttcaggaagctgttagagtccatggctgcattgtacgttggaatgctgctcagggggatcatcactttgggaagggccttggccgtgggcagtggctggtggacatggtgttgggcatgcactgggggctgctgctggagggagaggaactgtgctatgccagctggcaaaactggcactgttcctatcaggggcccgttggcggcatgggggttttttgcagagctggcagatgcctggctgactggaactgccccattgatgaaggaatggtccccctctctcacctccatttctccagtcgacagctttggtaaggcctcacccacaggctggctagggacattctccttgagtgtatgaatttttttggcttcagctttgcctttcattatcttcatgattggagttttggtaatgatgatttctgcctgtccatcagccccttcagcactgggctcacccgctaggtcaggagtgctggtgctctcagggatgctctgctccacaaccacatgattgtctggcttggccacgttccacacaaagctggcttccccggagtgacatgtggcattgtgcaaggaaagcccctcaggggtttttgccagaaaactgcacccactgcatacaaaggttgggtctttattaaagtctgtgtgctctgagttcatatgtcccacaaattgggtcatgtcatgggatctgaaatcgcagtatttacaggaatataaatagccatctaaagtgctccgatgcccattggccagtgtagagccatcagtactgctggggttctgtgctgcctcactgctggcagcagatgcttctgggggcagatcctgctggggtccttcaggcaaggtctcagcgggctgggcctccatgctggcatcttgcaacaccacagtcttcactgggatcatgcatggtgtggtggatttcctcttgctggccatggtgacaatcactgggtgatcagcagttgagagcttgtcccataaggggcctaacaatacaagttccagcttctcgatgagggccaaagaaacagtttctaaatgcagctttttcagttgtttgcagaaagcaggttttccctattcaatctaaggaaagggagaaaaaaatgattaagttctcttaagtgctttctgtatatttctcggatacccagacacattccactgcttgccttctaccatctaggtcttttcacagtaagtttaatcagcaacttggatatgaagtctaagttaggaaccccctaatgacaaaaactggaccctgaagaatgacctggggatggtccaataccaactgatagacttaagcaacgtatttttgtttcttccccaccaccccctacatatccctgcattaagtaattcagattaaaaaacaaaacgccctctttttggacctccaaattaattctgaccatgtcagagtgagaacaaaagatcctagtgtaattcttgtttacattttggaccaacacgcggttttcttttcatagccttcccgcatatgagaacaagatgacgcctctgtctgtcccaagccaggcccagggaccaagttagctgcagtgtgtgaacggaaggggtggggtgggcgggggtggctaggaagaccggctgctgtaagagccaggcctctgtagcctttccttgcctgccgcacttattccaggccacagaaaagcgatcaccttacagttactggctgttatgtatcccggaccactgttactgagatgaaaccaaaggtcagagggtcagggaatccacagaaccagtttgtggcccagcaagctatacattttctgtgtacgaccactcaaagggtggtctcaccttgagatctgagaacagttggactgcctccccaagtgggtccctgacccctgagtagcctaactgggaggcacctcccagtaggggccgactgacacctcatacagctgggtgcccctctgagatgaagcttccagagggaggatcagacagcaacatctgccgttctgcagtatttgctgttctgcagcctccattggtgatacccaggcaaacagggtctggagtggacctccagaaaactccaacagacctgcatctgagggtcctgactgttagaaggaaaactaacaaacagaaaggacatccacaccaaaaccccatctggacgccaccatcatcaaagaccaaaggtagataaaaccacaaagatggggagaaaccagagcagaaaagctgaaaattctaaaaatcagagtgcctcttctcctccaaaggaacgcagctcctcacctgcaatggaataaagctggatggagaatggctttgatgagttgagagaagagggcttcagacgatcagtaataacaaacttctctgagctaaaggaggatgctcgaagccatcacaaagaagctaaaaaccttgaaaaaagattagatgaatagctaactagaatgaacagtgtagagaagaccttaaatgacctgatagagctgaaaaccatggcatgagaactacatgacgcatgcacaagcttcagtagccgatttgatcaagtggaagaaagagtatcagtgattgaagatcaaattaatgaaatgaagcgagaagtttagagagaaaagagaaaaaagaaacgaacaaagcctccaagaaatatgggactatgtgaaaagaacaaatctacgtctgattggtgtacctgaaaatgacagggagaatggaaccaagttggaaaacactcttcaggatattatccaggagaacttccccaacctagcaaggcaggccaacattaaaattcagaaatacagagaacaacataaagatactcctcgagaagagcaactccaaaacacattaattgtcagattcaccaaagttgaaatgaaggaaaaaatgttaagggcagccagagagaaaggtcgggttacccacaaagggaagcccatcagaataacagcggatctctcggcagaaactctacaagccagaagagaagtgggggccgatattcaacattcttaaagaaaagaactttcaatccagaatttcatatccagccaaactaagcttcataagtgaaggagaaataaaatcctttacagacaaacaaatgctgagagattttgtcaccaccaggcctgccttacaagagctcctgaaggaagcactaaacatggaaaggaacaactggtaccagccactgcaaaaaacatgccaaattgtaaagaccatcaatgctagaaagaaactgcatcaactaacgagcaaaataaccagctaacatcataatgacaggatcaaattcacacataacaatattaaccttaaatgtaaatgggctaaatgcaccaagcagacctaactgacatctacagaactctccaccccaaatgaacagaatatacatttgtctcagcaccacagcacacttactccaaaattgaccacatagttggaagtaaagcactcctcagcaaatgtaaaagaacagaaattataataaactgtctctcagaccacagtgcaatcaaactagaactcaggattaagaaactcactcaaaaccgctcaactacatggaaactgaacatcctgctcctgaatgactactgggtacataacgaaatgaaggcacaaagaaagatgttctttgaaaccaatgagaacaaagacacaacataccagaatctctgggacacatttaaagcagtgtgtagagggaaatttatagcactaaatgcccacaagagaaagcaggaaatatctaaaattgacaccctaacatcacaattaaaagaactagagaagcaagaacaaacacattcaaaagctagcagaaggcaagaaataactaagatcagagcagaactgaaggagatagagacacaaaaaacccttcaaaaaatcaatgaatccaggagctggttttttgaaaacatcaaaattgatagacagctagcaagactaataaagaagaaaagagagaagaatcaaatagacacaataacaaacaataaaggggatatcaccaccgatcccatagaaatacaaactaccattagagaatactataaatacctctacgcaaataaactagaaaatctagaagaaatggataaattcctggacacatacaccctcccaagactaaaccaggaagaagttgaatccctgaatacaccaataacaggttctgaaattaaggcaataatcaatagcctaccaaccaaaagaagtccaggaccagacagatccacagctgaatctaccacaggtacaaagaggagctggtactattccttctgaaactattccaatccacagaaaaagagggaatcctccctaattcattttatgaggccaacatcgtcctgataccaaagcctggcagagacacaacaaaaaaagagaattttagaccaatatccctgatgaacatcgatgcaaaaatcctcaataaaatactggcaaatcgaatccagcagcacatcaaaaagcttatctaccacgaccaagttggcttcatacctgggatgcaaggctggttcaacatatgcaaatcaataaatgtaatccatcatataaacagaaccaaagacaaaaaccacatgattatctcaatagatgcagaaaaggcctttgacaaaattcaacagcccttcatgctaaaaactctcaataaattaggtattgatgggacgtatctcaaaataataagagctatttatgacaaacccacagccaatatcatactgaatgggcaaaaactggaagcattccctttgaaaactggcacaagacagggatgccctctctcaccactcctattaacatagtgttggaagttctggccagggcaatcaggcaggagaaagaaataaaggttattcgattaggaaaagagcaagtcaaattgtccctgtttgcagatgacatgattgtatatttagaaaaccccatcgtctcagcctaaaatctccttaagctgataagcaacttcagcaaagtctcaggatacaaaatcaatgtgcaaaaatcacaagcattccaatacaccaataacagacaaacagagagccaaatcatgagtgaactcccattcacgattgcttcaaagagaataaaatacctaggaatccaacttacaagggatgtgaaggacctcttcaaggagaactacaaaccagtgctcaacgaaataagaggacacaaacaaatggaagaacattccatgctcatggataggaagaatcaatattgtgaaaatggccatactgcccaaggtaatttatagattcaatgccatccccatcaagctaccaatgactttcttcacagaattggaaaaaactactttaaaggtcatatggaacaaaaaaagagcccacattgccaagactatcctaagtcaaaagaacaaacttggaggcatcatgctacttgacttcaaactatactatactacaaggctacagtaaccaaaacagcatggtactggtaccaaaacagagatgtagaccaatggaacagaacagagccctcggaaataataccacacatctacaaccatgtgatctttgacaaacttgacaaaaacaagaaatggggaaaggattccctatttaataaatggtgctgggaaaactggctagccatatgcagaaagctgaaactggatcccttccttacaccttatacaaaaattaattcgagatggattaaagacttaaatgttagacctaaaaccataaaaaccctaggagaaaacctaggcaataccattcaggacataggcatgggcaaggacttcatgtctaaaacaccaaaagcaatggcaacaaaagacaaaattgacaaatgggatctaattaaactaaagagcttctgcaaagcgaaagaaaccaccatcagagtgaacaggcaacctacagaatgggagaaaatttttgcaatctacccatctgacaaagggctaatatccagaatctacaaagcacttaaacaaatttacaagaaaaacatcaaagaaccccatcaacaagtgcacaaaggatatgaacagacacttctcaaaagaagacatttatgcagccaaaagacacatgaaaaaatgctcatcatcactggccatcagagaaatgcaaatcaaaatcacaatgagataccatctcacaccagttagaatggcgaccattaaaatgtcaggaaacaacaggtgctggagaggatgtggagaaataggaacacttttacactgttggtgggactgtaaactagttcaaccattgtggaagacagtgtggccattcgtcaaggatctagaactagaaataccatttgacccagccatcccattactgggcatatacccaaaggattataaatcatgctgctataaagacacatgcacacgtatgtttattgcggcactattcacaatagcaaagacttggaaccaacccaaatgtccatcaatgatagactggattaagaaaatgtggcacatatacaccatggaatactatgcagccataaaaaatgatgagttcatgtcctttgtagggacatggatgaagctagaaaccatcattctgagcaaactatcacaaggacagaaaaccaaacaccacatgttctcactcataggtgggaactgaacaatgagaatacttggacacagggtggggaacatcacacaccacggcctgtcgtggggtggggagagggacagcattaggagatatacctaatgtaaatgacaagttaacgagtgcagcacaccaacatggcacatgtatacctatgtaacaaacctgcatgttgtgcacatgtaccctaaaacttaaagtataatttaaaaaagaattataagtaatcttcacatatgcttttaagtatttttttaaaagaaaggaaagaagaaagaagaggaaaccagaaacaaataatcattacactatccagacattacataacatcccttacctgtgaatttagatgtattgaacttttaataaaatagattgacttcacacttttaaaatgctaagaaagaaaacagctaaggcagaaaactaacctgaaaacaaaaccaatggttttatatataaaagaccgaaattaaacagttgataactcaaaaagaaataataataataattgtttcacaggatgccatgagaaaagggattctgtgagccctattactaatatagaatgataatcatcattattacttttcgttttagcaaatcataatgctctaatgactaaaacaatagtaattctaatactaaaatcaagttatcagtatttggatttgatacaaagatgtaaagaaaattaaaatatctctattcaaattctcagtaaataaacacggctattttatgatgaaaataatttttaaaactttgaaggtgagggtaaacataaacccactctaacaacttctcaccccttcccccaccaatttgaactggcatgcacacttttttacttaatttttaattataaagataaaatgtaatttaaataaatttaatgtctataatttggtataccttctcatttagtccagatattttattcatatttttatcacaatgagcacacatttgtgcttttttcaccaaacattacgttataaacctttttgttacacaagcttcataagtttaacatttaatagctacctaataatgtaccacaatgaatttgacttatccacccctgctgttgaaaagcatgccaatctcatgggtgacagtgaaacaaacatctctgggcatacaggatgtttttcttctatcaaattatttcctgaggttaagtgcacaggaatgggcttaccatctcaaagagcatcaacatttctaagctcctttgtatatatcattggcaaacattttaaatcaagtgctttatgatcccaaatcagggaaactaaaaataatacagttatggacccagtgagcaaatcagattttcagacaagttatggaagacatcaagtagaatatctgaaagcacaaacgacaaaagaaaaaacagataaattggatgtcatcaaaattaaaaacttgcattcttcaaaggtcaccatcaagaaagtgaaaagatagacaatccacagaaagaaaaggtttgcaaatcatctatctggtaaagtatatccagattatataaataacttacaactcaaccatagaaagataatttttaaacgggtaaaggatttgaatagacacttctccaaagaagatatacaaatggccagtaaagcacataaaaaactgctcaacatcattagttattaggaaaacacaaatcaaaaccacaatgagataccacttcacacccaccaagatggctgtaattacagcgacagataacaagtatagatgaggatgcagagaaactggagccctcacgtattgctgatgaaaatgtaaaatggtatagccactttggaaaactgtttggcaaacaaaatgttaaatatagagttgccataagatccagcaatttggccgggcgcagtggctcacacctgtaatcctagcactttgggaggccaaggcgggcggatcaccagaggtcaggagttcaagatcagcctgaccaacatggagaaaccccatctctactaaaaatgctaaattagccaggcatgttggtgcatgactgtaatcccagctactcaggaggctgaggcaggagaattgcttgaacctgggaggcggaggttgcagtgagccaagatcatgccattgtactccagcctgggcaacaagagctaaactgtgtctcaaaaaaaaaaaaccaaaaacaaaacaaaacaaaaaaaacaaaacaccagcaatttaattcctaagtatatacacagtataaataaaaacatgtccaccccaaaatatgtacacaaatgttcacagcagcattattcaaataatggccaaaaggtggaaacaacccaaacatctatcagctggtgaatgggtaagtaaaatatgatatatccatacgatgaattcttcagccatgaaaaggaatgaagttctgatgcatgctgcaacatggatgatcctgatgctaagtgaaagaagtcagacacaaatgtcacatactgtatgattcccatttatatgaaatatccagaaaaggcaaatccatagaggcagatagtagattagtggttgccagggactgagagtaggggagaagggggagtggctgctaatgagtcaccaggcaatgaaaattgttctgaaattagatagtggggatggctgcacaactctgaatatgataaaaacctcaggaaggacatcgaaaccaagaaaggtagaggacagtaaattatagcactcagttctatagaagagggtcagcatttacatttctaaggtttcaatataggtgacacagttctgtgctacttcctgactcaccttggtaatatttactgtggccctagagaagctgaatggcagtgcctgtgaacatcaggtttgccagaggagagggaagagagatgcagacctactacctggaagtagcaacaacacaaaggaaaaagagcatgagcacaccagaaggccaggcagcagaactcaggagaagctaactgcagagccctagcaacacaacacaagcactccaggcacagggccagaactgctatttgtaatggggactgggattcactgaggaaaaggtatatagtgttcctggtattttacttactaaggctgagaagtggacaacatgaagatggatttgatttttggcaatagtcccaatgtcattcaaaattaagtcttggccaggcacagcagctcacgtctgtaatcccagcactttgggaagccaaggtaggaagatcatttgaggccaggagttcgggattagcctgggcaacatagaaattgtaaaaaattagtcaggaacaatggtgtgtgcctgtagtctcagctactcaggaggctgaggtgggaggatcacctgagcccaagagttcagagttacagtaagcaaggatcatgccactgcactccagccaggatgacagagcatgaccttgtctcttaaaaaaagaaaaattaagtctcaaattagccctaaattatcattcgaataaatgactaagaagggtaccactgctaaccatgttctgggtagatggaccattgactataagcaattacaaaaaagcagtagtggcagcagtggcagccacagccagtgtttactgagtgtttcatattgttggaagtgcttttatacacatcccctcatttcactcataataaacccaagaaaaggcactataattattctcattttacagacaagaaggacaaggctcagaaaagtgcagtgactgcctggagcgcacacaactgggagacgacagaagctgaataagaacccaagcagtctcgctccagagcctgcaacttcaaccactccacacagtgagctctctgagaaacctccagattgttgcaataagggctacagacctcttgaagtaatattttcctccagcatttattaagaaaaagttcaaacaaatggcaaagttgaaagagattgacagtgaacacccatatccccaccacctggatgcttactaaggtggctgtttttagcaacattacccatttaggtaagcttgggtttatttgttatgtatttttaaaggggttaaaaatggtgcttaaacagcaaagttctaattatctagaaaatcattcatccaaaagacactcatggagcatgtctgataaatgaggcactaccatgtggaaacatgctattgtctaagtcaagccctagtgaagtgagctgatagaaatgtaaggtgcggccaaaagagattcagaaggaaaggccaggtgatgtttgcattttgtcatttttgtacaatcctttacatgccccatcttgaaaccttctgccttgtaaatggatctttaaatggggccagagcagtggctcacacctataatcccagcacttggaaggccgaaacgagtggatcacttgaggtcaggagtttgagaccagcctggccaacaacatggtgaaaccccgtctctactaaaaacacaataaattagccaggtgtggtgatgtgtggctataatcccagctatcgggaagctgaggcaggagaatcacttgaacccaggaggcagagattgcagtgagccaagatcgcaccactgcactccagcctgggacacagagtaaggctccgtctcaaaaaataaataaatacaaataaaaataaaaataaataaatggaaaaataaaaacaaaagtgcataactttttttaaaaatctgtctttgggaattggtaattgctcaattcactaaattagcaaagctatagttaatagccactatatttcagcactgcagtatacatatgtgagttttttagataaaaatcttaaagtgtttatctttaaattatagactgaattaggaactttaaaaaattctgaggaatgaattggaagaacagtaagaattcaatgaaggaattcaaatacttagaaagtaactcttgacagactcttccaagcgttatgatagtcagcctgcagccctcttgaacatatcacccagtatttatcattaaaaacggaaataggccaggcgcggtggctcacgcctgtaatcccagcactttgggaggccaaggagggtggatcacaaggtcaggagatcgagaccatcctggctaacacggtgaaaccacgtctctactaaaaaaaaaaaaaaaaaaaaaatacaaaaaaattagctgggcattatggcgggcgcctgtagtcccagccactcaggaggctgaggcaggagaatggagtgaacccaggaggcggagcttgcagtgagcagagatggcgccactgcactccagcctgggcgacagagcgagactgtccaaaaaaaaaaaaaaaggaaataatggtagaagttgacagaattacagaaacataactatagtgggagattttaagataatattctaaagatcaagtggacaaagaaaaaagatgtaaagaatgtgactactatgaggttgatctgacagacatgaatatagtcttgagtattctatagtaattgacttcacattctacaccatgaaacacatttaaaagttactcgtgatgtataacagaccataaataaacctcaacccattccaaaataaaaattcataggtagcattccactatttagtgctagcaacaaagacttactttgaaatttatcctttttactttgtttcaaattatgctctaagtggaaatttctctctcggaaagaaagaaaagtgaaaatccttcctattcacccccagagataaaccattgttaacagtgcagtatatatgatttcaggcatgtttcctaggcatagcttactataattaattcttttaaaaaaccaaaaatggaattgtatttttacatcctattttgaccctgagttttcgtctcacaattatttaatttcaatatctttccatgtcaccatctctagtttacctcagtcttttaaacaacttcagcattctaggttatggatgcatcatagtttatttaaccattctcctgataagagacatttgcatttctccaggtttttaactattacaatgactcggtgaccatccctgcacatatttttatacatttgagaatttctgaaatactgaatttcttacaagtaaaattgcagtagcatttaaaatattgttagcaaaatacaaaattgtctttcaagtaaactgtactgattttcgctgttaccaccaaagaactgaggatgcactcactatcactgcatattcttgctattttcagtctttgttaatttgatatataaaacactaattactagtatttggaatctacatttctttatgagcaaggctgaatatcttttcacatgtcattgacgattttgtataaaattatcttttgtccattttcctatgggatgtcaagtgttctccatatattaagaaaatgggctattctttacctgtcatagatgaaactggggtttcatctccattttttggagcccatctaccacaggaggcagtaaatgacattaaagaattactgttaatgttgctatgtatgataatggtatttcagttatgttacaaacaaaagtcttaatcagttggtgatgcacactcgaatatttatgggtaaaataatttgttatataggatttactgggaggaaaaacccaaccccctagaaaaaaatgagggatgggtagaaatacatgaaataaatttgaccatgaacttataattgttcaagttgggttgggatatatatggctcatatatatgctcttatgtacatttgacattttcataattaaaaaaaaattaaaagctcgagacatattttaaaaagaaatcttgtatcataaatgaagcttaaatttatatttttaaaaaacattctgttttaaatgtttctctcttcccttcctttggaaaatgctgaccttggaaacaaaaatcagatgcagccacccaccctactgctgcccaagccaatcctaagtaaatcagttggcttgctgggaagtttccatgaccgaaaagaaaacagaattcacttcaatttcatcatcaaagtccacgaaagcttgcaaagcacttccatatccttctcaatccatcctcatagtctcctgaattggttattattggccttccctcattgtagtattgaggagctatcgagcaagaaaggggaggtgatatgaccagtcacacacgacatatttttggcagagccagatattctgattctaaattcagtgttctcttttagactatattcattctgaataccaactaaacaatacatccactacctgtaactattttgacatttttttcttacagagggttcgaagattttacaacctgaactattctagtgttttgttttgttctttaaaaaggcttgacaatgtagtcctagctacttgggaggctgagatgggaggatctcatgagcccaggagtttgaggctgaagtgagagctatggttccgtcattgcattccagtaatgtgggcaacagagcaagaccctgtctcctaaaaatgaaaaaagaggctggaccagtggctcatacctgcaatcccagcactttgggaggccaaggagacaggattgcctgagcccaggagtttgagaacagcctgggcaacataaggagactccgtctctacaaaaaatttaaaaaatagctggcatggtgacacgcatgcttgtagtcacagctaattgggaagctgaggcggatgactgcttaagcctgggaggtcgtagctgcagtgagttgggattatgctactgcactttagcctgggcaacagagcaagaccctgtctctaaataaataaataaataaataaataaatggtaaaaaggcttgacagttattatgatccttagtatttataacacttttataccgtcagaagagggtctgtattgcttactcttatgtattaatagagaactcttttaacatgaggcttggtgattagaccacggtaagtcagtaggactctataacaaaaagaacatgtggaaaactgtccttcctcaggaatgtgtgtgggcaggaccttggcagtccagtaagtggatgtgctggttgcaattgtcagatttctgctgaaaacaaaaaagttacaaagaactcaagtctaaatcctcaaatgtcaaagcaatgtcaagcccagagctggcctcaatttgccctctggttacttaagggtcacaataatttctgcatttagtaatcaccatcagccaagggctcaaggctagagctctctacttgtttttccccctcaaacagtgctgttttttttttttttttttttttttgagacggagtctcgctctgtcgcctaggctggagtgcagtggcgcgatctcggctcactgcaagctccacctcccgggttcacgccactctcctgcctcagcctcccaagtagctgggactacatgtgtctgccaccacgcccagctaattttttgtatttttattagagacgggttttcaccgtgttagcgagcatggtctcgatctcctgacctcgtgatccacacgcctccgcctcccaaagtgctgggattacaagcgtcagccaccgcacctggccttccccctcaactcttatttttgtctaatcaccaacagaaatagcccactctagtcagatattatcacctctaaagtaaacattaatttgttctttctcaagctcagaaggtgattgtgatataaatacaaaggcctcagaattaaagagactttagagatcatatattctaaccactcacctttgcatgaattttaccttaagtaccactaccaggtggttaggatggcctatacctgaagatctccaaagatagggagcttggcacttattgacactagaaagatgtttgaaatggttccttgtagtaagcaccaaaaacaacaaaaccttcctataagttttatttgctaaatttgttttttctctcaaatagagttgaggacttactatgtgctaggcactgggtatacaaggatttttgaaaagatgctagctagccctataactcaagaagctaacagtctgttgtggttattaagctatccaccagggctctgggccttgccctccactggatgcattgaatttccctgcctacctgaagttaggtgaaaccaatgaaacgtgaacaaatgtgtcacctccaggggaaaagttttatgagaaagtataggctttgcctcactatttattctctggcctgcaactggttatgttccagatggcggctactctatcagcctgagtcctaaaagaagaacaatagctgacctgccatgtacatgcagtatgaacaagaaataacctttgtcactttaagctactgaggtttttggagtagcttgttactgcagcccatcctcactgatacagagtctgaagacagacaaacaaaatcatcagcaaaatgatcaacaaagtcatcaacaaaatgatcaacaccaatcagacaataagctgagtgttgtagtggaagcatgcacaaagttctgtggagcataggaaaagactttctacccacctctgtcttccggggaacttggggtaaggcctcatagaggaggttgcttttggattagagctcgaaggatgaataaatactgccaagtagataagttgagaaaagagtgttctagacaaagggaacactttatacaaaaaccgtagagggaggagaaaacatggcatgattggagagctagaaaggattcagttttgctattgtacaaatctgaatgtggtagatttcctatgaagctactacagccgaagctttggggaccctcacttcacttgcacaggcaccttccaaagcctctatctaactttatatctttataattttattcttagatttttttcttaggagggtcccctttactaatgttcaagttccacaaaagctggatctgcttgtgatggatcaggttgcaggaataggaggtgattctaggtatacaaacaagatatttgactttctatatgatacagttttttttggttttttttgttttgttttgtttttgttttgttttgttttgaggcagagtcttactctatcacccaggctggagtgcagtggtacaatcacggctctctgcagcctcgacctcccagactcaagtgatcctcccgcttcagcctcccaagtagccagtattacagatgcgtgccaccatgcccagctattttttttttgtagagatgaggtttcgccatgttgcccaggctgatcttgaactcctggactcaagtgacccacccgccttagcctcccaaagtgctgggattacaggcatagccactgtgcccagccgacacatttttcaattggaaaaacgtgattttttggaaaaaaagaatcatgttccctaaaagtcttcttttcccctaaaccaataatcctcagttcctgtactttgtgtgactgggacagagactccacaccactctccactgttcttctctgaatgtgctcttatttgtctatagccttctcaacagtggcatctaaatctaaatctaattctccagatgtagtctgagcgtatttatcaccttccttaaacttactcatgtcatatttaatctttcacaaaagtttttacccaaacgatgccacattatttataatgtgagattcccctgaaaaatatggatcaatgctcttggatttaatccacagcaccaggacttgtaccaaaatacaatacctgcttgtttcaatttaggtttggcagaatttgaggaacaagtttgcagagaaaagatagtcaattcatttaacaaatgtttactaaatgccttttctatgccagacatgccagaatatggggaagacaaaaaaaaatagatagaaatctctgccttcctggaatttacattctagtttgggggagagagataataaataaaataagaaaatgaaattatgtgtcagagcaaaaagtggaagaaaagcatagcagtgaaaggctgaagaaatgtggagcatggcaggggtgagactgcaatttagatatacagtggtcagaagagaactcactgagaatgtgacactggagccaatactcagaggtgtggaagtgagccatctgggtaagtgaggaagcacactccaggcacaggcatcagctggtgcaaagaccttgaggtgagaatgtgcctgacatgttcaaagaacagcaaggaggccagcagagctgggcggcggtagtagagagacagtagtatgagacaaggtcaaagaggctgtggtagggggcagggaggggatccatgcaggtccactgccatgatctgagtctctctgaaatgggcagtgccaagagagggctttgagcagaaggttggcgtcatccgacacgtgtccttcagcatggctctgctggctatgttgagaacagactgtaggaaaacacagtggagaagtagggaaacttgtcagacatcaatctaggcaggagatgacagcagcatggaccaggatggtagagatggaggtaagaagaagtggctggattctggatatgttttgaaagtaaagccgaaaagacttcctaaaggaatggataggaggatgtgaacattgtagccacgggaatcaaggatgactccaagatttttgatctaagcaactagaaggatagtgttgccatcaaccaagataggtttaaacctgggaagctttgtgaaaaaagcaaagcaaatctgtgctgctaaaactagaaggtccttttccaggggaaaaactggattgaactggtttggtcacaagtgttgtaggaaattaatgggtcagactgctaatgagcaaagaggctgtgtagtgccaatgttcccaatgaaaagactctggtctttgccaaaagctgctcaaatctacagagaaactacagaaatgggggttggggggaggctgggaccaaatctagggtattataagagccaagtagttagaaattgcactctctgaggtgtgagacagcgcctttcaaagttaaacatgttactttaaatgtacttgcatcctaaatgttgttccaagtactaagtaaattactttattaaatttaaaactaaacagtaaaaaagaaattgttctggatgtggttttacttctgagattacatttgttttgttttaattgaaattttccagtgtgggccagatagtttacaggctgaatagcttgcaggctggtgagctcacttgaatttctcaagaacatttgttaaaaaaaaaaaaaaaagaaagaaagaaagaaaaattctctctggctgaccactgtggataagatgttccttttacctcttccaggcttagtctgtattgatgattttcttcaatggcctcactacaaagtccagcaagatcttacacacaagaaaaaatgctcaatttcactcacagtaagagaaatacaaattaaaattactctgattatttttctttcacttactttggaaaggcttgaaacattggataataatatcctgagttggcaagggtttgcagaaataggcactctcatacactgcttgctggagtgaaaattggtaagacttctattaagaagtatttaacaagaacaaaattataaaagctcattccctgactcaccagattctgcctctaggaaggcagcctgctgatatactttgcacaatggtaagtcatacatgtataaggtaatctactatcagcatggtaatggcaaaggactggaaataacctaatcactcatcaacaggagataatcaaatcaattatggcacacttatacaatggagtaacacacttgtgaaaaagaacaagggaggtgctttttatgctgctatggattaaccttcaagctatcttgatatatgttaagttttttaaaaagcaaagcacagaataaaaattatacgctagaaatacctcgagaaaaatatgtgagaaactaataatagtgtttgcccctggcgaggggaagagggagatgtgtttgagggaagcttttccctgtagccccttttaaattctgaacaatgttaatgtgctatgtattcaaaacaaaaagttaaaaattgaataaatacataagtggaaaaaatgttagcatatttcccaaaatacatgggttgttacaaataacaagtgagaaagtgagaagctaatggcgtcagagtagaggtccttacagagtatgtaactgggtcaaataccaagtagtgctcctttacatttcaaacttctaatagctacagatgagcttttggtgtaacttctgtaggggtgcatgtgagcacttcacttaaaactatatattatatattgcatttgcctctggccataaagccatagttcaaaaataacttagagatatccaatatacaaaacaaaaaataaataaataaaagaacaagcaaaacaaaaaaaatacccaaaatggaggagtgggacaatatatgcagtccaacttctttcctaattaaaaaatcctgcagcaatctgttatccagtctccaactgagtatctcccaaatgtgggagctaattatcatttatgacaatttattacaaagcccctttcttagttggacctggttcccagcttttagatttgtcttttggacataaatcaactctttttactacatgacgcatcaactctcttttctatatatcagcttttcacacagttgaagatcatttcctcttttagtatttacttctgcagctaagtgtcctgaattcattgcacattctctctatacattctaatttgtctgcatttctcacaaaatgtggcaattagaactgaacaaagcattcaagatgtagcccaaccagaagagaattaaatggaagctgtgttttcatcatcctattaccatgactaatacaaccaaaaactgagctagatacaagttctattctccccctcacagaggaggactttgaggtgaagtgacccagtgggacaaggaaacactgctagaattaaggaggattaggattctttcatcacaaggccatttggatacacgttttcagacactcatttataattccaacagaggacttctgagctatcttcccctttgcctctttgaaatctaccttcttaagaaaggaatgttagactttctctgaacatcctatctaaatgtctttgggggctcccccaaatccaagctgaattattctctatcacagcatcctaattgtttctttcataacatttatcaaaatttgtctggatcttcatctgattcttttcctgcttattgtctttcactttggctaggctgtaagctctgtaagtaaggtcagggcctatatccactgtttccgtagcatatagcacaatgtctggcacataataatcgttttcagtgagtgaatgggtgaataaacggtagctgataatggagttaagactctaacatcagacagagccctaacactgtggactgtgtattcctgggcaaatgacttaagtcctcacaatccatttcctcattggtaaaatgaggagctattaatacctacctcatagacctgacatgacattcggtgaattgataggaagtacacaaaatgatttagcatgctgtctgatatacaggaaacactcaataaatcatagttactgcagctactgctactgttctaattaccaccacatcccactcagaggctggccactgaaggatgacaattaactgtaacagctagaggtacatcagctgttttacccagcctacctttctttctttttaaaaaattgtgataaaaaacacataacataaaattcattgtcttaaccatttgtttttttcttttgagatggagtctcactcttgtcgctcaggttggagtacagtggcgtgatcttgactcactgcaatctccgcctcccaggttcaagcgattctcctacctcagcctcctgagtagctgggattataggcacctaccaccacgcagggctaatttttgtacttttagtagagacagggtttcgccatgttggccaggctggtctcgaactcctgacctcaggtgatcagcctgccttggcctcccaaagtgctgggattacaggcgtgaaccaccgcacccagactgtcttaaccatttttaagtgtacagtaaggtagtgttaagcacattcacattgttgaccaacagatgcccagaactttttaatcttgcaaaagatgcaaatactatacccatcaaataactattccccttactctcttcccccagcccctggcaactaccatactactttctaagagtttgactactttagttacctcatataaatgaagttatatttcaagatgtagcccaactagaagagaatgaaaagcaagctgttttcatcatcctactaccactactaatactaccagaaacctagctagctaaaaaaagtacttatcttgggctgggcgcggtggctcacacctgtaatcccagcactttgggaggccgaggcgggtggatcatgaggtcaggagatcgaaaccattttggctaacatggtgaaaccccatctctactaaaaatacaaaaaattagccgggcgtgctggcgaatggcatgaacgcgggaggtggaggttgcagtaaactgagatcgcgccactgaactccagcctgggtgacagggcaatactctatttcaaaaacaaaagaatttcctttcattttaaggctaagtaatattccatgatatgtatatatcatattttatttatccattcatccactgatggacatttaggttgcttccccctcttggttattgtgaataatgctgcagtgaatatgggtgtgcaaatatctctttgggatcttattttttattcttttgggtatacactttttcttgtttaagctctccacaatcctatgatgctggcagagcagcagaaatcacaggagtcatcaattcgtctttaccttttttgatcctgtcatcaaattatcttcctctcaagctcactccctagtcctttctgataacctcctggttcctctattttcaagtgaattcaacaggtcaaatttaaaatttattttacttgtccaaaagggaaggaagctattatacctttcctatccctttctgttggaagaactctaggttcctcatccagagaagggtactgccccaggtctgagcagaatgaagctgcaggtactcagggtctaagccccctggaacaatagagggctatggctctaccttagtcggcccaggacagtttctaaaatgtttcctttatgagtactgttttgaatgctgttaatatttcatcaggaagtatcagtttcccttgacaggtaagattaagtcctattcactgggttgatcagccttatcattacagccaggatatttctctgcaaatccccttccaatcttatgctgcccaactaatgggaccaactggatttgctcaataaagttctgtattttcccagagctcttcattttcacattattgtcctggggtggggggcagcagaacagagatgttgacagccaaatggaagatgcattgggaggcttctgaagatacttgttctgtctttgagaaaccttagagcatcaaggtgaagcaaaaggaaaggagaggaatagtgctcagtacctgagccttctctaatctaaaacgcaataaagtcaatcataaatcctgaaaatgagagtggctgtgatggtgcaaaatataaaactccaacaactatttatcaggaatgaagtacatatatctccctattcgcatctcagccttcctcctgcaatatgtgagtgagtgtgcatgaacccacactcaccagtgatacactcaggagagtactggggaagagttaacttccgctgcaagatagttagcatatttatttcctttccatgagacttcaggagcctaaatcagaagtttctaagagcttctcttgatgtcatatattctgagaatggatacatctaagaactgatgtaatgtgtctgccattatgaatttggtaaaagttctatttatctgtttttaaacaaaaggactgctttaatgttacatattggtttgttattacatattggctggttatttgttattggttgtttctatgacacacttggacaagaaaatttctagtccaagtatatcatagtggtattacttgagacaccacttaaatctcataaaaatagaaaagatcccctaactggcctctcccatcttccccctcccccatgccagactgcctctgtcccacttattcaacttccttgctcatcaatctttggtgcattgcaggccccattccttcctctccttctgcccaaaccacttgcaccaaggtcatcagtcaagtggctctttcctactccttcaagtctcaaaccactcaggacccaaaggaagttaagacccacacctctataacctctccaaagggagcaaactcatgcccaggactttgcaatctcctctacccaagagatttccaaatcacccttgccagccctgacctatctaccaagttccaaatccattacttccaactgccattgatccctgcaggttttaaaaaactacatgcataaatttctggctccgttgaccctggcactcacccttccaaaaaacgaaacaagcaaataaaaaatatagcctaggtctacttcctaaatcttcatttcacctctcaccatttgtcttagtccgttcggggtgctataacaaaaacatcatagactggatggcttataaacaacagaaatgtatttctcacagttcttgaggccaggaagtccaagatgaaggtgctggcatattcagtgtctggtgagggcctacttcctcatagacagacaacttcccactgtcctcacatggcagaagggaccagggagtgtctggggtctcttttataaggccactagttccattcatgagagctctatcccagtgacctaattaccctccaaatgcctcacctcctaagacaatcacattagggattaaaatttcaacacgtgaattttaggagatacattcagtccactgcaccatacatccagatttccaagcatacttatttttttcctagtttcctttattcacatctctcttttctcttttcccacatgaaatgttaatggtctcggaagcacttaacatcttttcttggtagagggacttttagaaattgtggtaaaatacacataacataaaatttaccatcttaatcatttttaggtggagagttcagtagcattaagtattaacacagtcacattgttgtacaaccatcatcaccatctgcctccagaactctttgccttataaaactgaaaccttacacccattaaacaataactcccatttcctgcccacccctgactcctgacaactaccattctgctttctgtctctgtagatttggctactctaggtattttacataagtggactcatatagtatttgcctttttataactgatcaatttaacttagcataatatcctcaagtttcatccatattatatgtcaggatttacttccttttaaaggctgaataatatccccctgtatgtatatacaacattttatccatctatcaatgaacacttgggttgcttctaccttttgcctattatgaataatgttgctatgaacatggacatacaatctctttgagtccctactatcaactcttctgggtaactacccagaagtggaattgcttaatcacatggtgattctatttttaatttcttgaggaattgccatactgttttccataacagctgcaccattttacattcccaccaacagtgcactgagttcccaagagttctccacattcatggcaatatctgttattttctttttttttcttcagagttgccatcctaatgggtgtgaggctgtatctcactgtggttttgatttgtattgcctaattatattaacgttgagtatttttaatgtgcttattcatttgtgtatcttctttgaataaatgtctattcaagtcctttgaccattttaatcaggttgtctggggttttttgctgtttttgttgggttgtagaaattctctatatgttctagatattacccctttattagatatatggtttgcaagtgtcatgaagcttttctcctctgtcttcttctaagcattttatagttttagatcttttgtttaggtcttcgattcattttgagttaacttttatatatatggtgtaaggtaaggatccaactctattattttccattagatagccagttttctcagcaccatttgttgaaaagactgtcctattcccattgaaaggtcttggcatccttgtaaaaaatcatttgaccttatgtgtgaggatttgtttctggtctctccattctactccattggtctatatgccttcattaacaatttttaatattaaatagatgttgaaataatattttgcatatattgggttaaatatattcttagattttttttttttactgtttcaatgtggcccataggacacttatcacgtattggctctcattgtatttctgttggacagcactgcctagatgcttcagactggagccaccgggcagtgtggagagcaacagctaacgtcatgggattagatgatcatctgaaagctcctctcctcttgtgtttatcattatagtacttagggagcaggatatcactgtggctgagaattgaggcttctgagtcaggcaagtccaggtttcaagacctgccctgtccaacacagcagccactagccataggtactcatgtatgtactgagtatctgaaatgtggctaatgtgaattgagatgtactgtaaatgtaaaatacagaccagatttcaaagactcagtaccaaaaaaagtaaaatatctagttaataacttttatatcaattacatgttaaaatattagtatttctgataaattgggttaaataaaatgtattattaaaattaatttgacttgtgtttcttagtaggctattttttagatcaagttcacagcaaaactgaccagaaggtatagatatttcccatatacccactgccccacacatgcatagcctactccattatcaacattccccaccagaatggtacatttgttacaactgatcaatctacactgacacatcattatcacccaaagtccacagtttacattagagttcactcttggtgtacattctatgggtttggacaaatttataatgatatgtatctacaatattataatatcatacaaaatagttctactgctctaaaaatcttctgtgctctgcctgttcatccctccctcctccctaactcctggcaaccactgatcatttactgtctctatagttttgcctttttcagaatgtcatatagttggaatcatacaggtatgtagcctttttggattggcttctttcacttagtaatatgcatttaatctccccccattgctttttattttttgacttgttaattttgattttttaaaaatgtggctcctagaacattttaaatgacatatgcagctcaccttatgtttctgctgaacatttctcagcttggcatgggcagtttttctcagcatggcatcttcctgtctttccagtcactcaagtccaagcctggttgtacttggtttgctgcaacctaaacacaccagcctccttgccttcacacatactagagttccttcattagagttttctttaaccccctccctcacctgaagactaattcatgctcagacccaattcaaatacgacatctttagtgaagcctttctaaacttccactgtacctaaatcattttttatagcacattctaccttataatttttttgtatgtggctgactttctctccagattgtgaaatctttgaattaggccccatgttttgttcatctttgggtcctcaatccttagtacagagcctgacacatggtaggcaatcagagatgttaagttaataaatgaataaaatgcaggaaaattaacatatcctctaataagagataacatattcacttagaatcaaatagcttagaaaagaacctcaaatgccataaacaagggtgtaaaattctatcagccaacagctaaaattattcacaagctaaaatttgtattcagtcaaagcaacacattaatcaataatatttataaagtatatcacagtgaaaagatggtaaagcacctcctaatggttaatgatagtgattggcctggagatgtggaaactagctatggaaactagatggttaaaacaaccacattccgtaccattagacgctgacagcccagaccccaccaaaatagaggcagtgaaacagcctttgaagttgttttcaaaggaagccaccaagatgattaaagggttggaaaatgagatttatgggtaatggccacagaaacgaagacaattttgcctaggcaagagaaaaggccgaagggtgacttaataaccatcttcaatcattgttattacacagagaatgatgaccagatggtctccattttcaccagagaaagaatattgaaaatggacttacgctgcagcataaaaaaaaaaaaaaggtctagttttaaacaaagaactcaatggttaagaactagtatacagcaaagcagacctggggagtgtgtggtgtagccatgtctgaactcatctgttatgctgggaaagcagcaagtgggtagggtgtgttcaggtcttcaacagtcctttgttgagggcaaattctcaactggctagtcctcaaatgaatcacgtagcatacaaccacaggagtggaaaagaaagagatatgaaaattgaaacacagcaccctctggtgtacatagctgtcttctaatctaggaaaattcttcttttttttttgagacggagtctcgctgtcgcccaggctggagtgcagtggcgcaatctcggctcattgcaagctccgcctcccgggttcacgccattctcctgcctcagcctcccgcgggggactacaggcgcccaccacctcgcccggctaattttttgtatttttagtagagacggggtttcaccgtgttagccaggatagtctcgatctcctgacctcgtgatccccccgcctcggcctcccaaagtgctgggattacaggcatgagccaccacgcccggctggaaaattcttgatatgtatcagtatttttcaaaatgtaagctccaaaccatgacagagtcaggagaaacttacacaaggctggtcttagggttcgtttaatcgctacatccatctttatcaagcacctgcgatgcatttctccctgttaccaggaggtaccaggaagcctgttacacaagcaacctcaacttctgcctatagcaaacttggattcttcccaatcaccttttgaatgctgaattcagactctgatacaactagctggcacatgaccatgcaatgctgagacatgataacatctgccagataatgtgaattttgccctgtgttcaggagtacattacatataaaagttaagcaacacctaaatgggggtgttcccttagacattctccctgctatgttgtggtgtatacacccttctttactgatctctgtctgccaaatcccagccggccactttttacatcctcctaggctttatgctgcaaaaccttcctaatatccttttaagtacaaaagacattcaatgagctcaaaaagtttgagacccaatcaagaatcttttgcagccctctcagtatctttagccatcttgttgccagatgggaacttcattcacatgacacacatacttccttcatgtgactcaccattgctaagcaactggtatgtcctaggtgaataaaacatatgccctgtgtctgagattcacagtgcagtaggggaacatggatagatacgggtgtaaatagatcagctgaagcatgagttgaagctcaaggctctacatgccaagaacagaggaaaaaggcaatggagagaccggacaagaactatcaggacatcagaacagaacttacatcctgtgagagcaggacttatgctaaaaacaagtcttaaaggatgaaaagaagttgtccaggcagacaagacaggaatatgtatcatcctaggcataaagtcccaagacatgtcaccttttgaagaatggagccatgtggcacactgtcctccagtcccaaaggtctccttgaagagacatgaaaatcccacctgaagaactcacccttgcagattgtacatagcacagacctaaatggcaacaaacaagcaaacaaaaaacgcagtacagactaggcactgatctgatggaagcgagacaggctggagtagcaaagggtctgactaagaagcttaggaggaattcctctgatacccttcttggtgccccctccccagcaacatctaacagcctcactcgggcccaacttccctgttgcactggtggcactgcattgcaattgtgggtacaagattcctcccccacaaaactgtgggctgaggcaagagttctacctttttattactacgcctctgacactcagcacatatgaagcacaagcaaaatttgatgactaagctaagtaattagttcatatgtgtgattagggtttgaaagggcagaaccttggacctatgatcccaaatacctttgtctatctagttcacctggttttgttcctcctcagaagccatctatcctccttaccttggttcatgttttcctatctctccattttatacacataaaccaactcctaccctcaaatcagggaaaagggacagatattcctgtcctcaagttaagagtgacctatgtcaaagtgaaaaacaactaagccaaaaaggtaacagggaactggcttcttgagcactcagaagaatttgagattactgcctcgcgagggaaaaagggaaacccaacccgattacagtgtaaaaataggtcactgcttgaatacagccctttggttactggctgcaagcccctttttgcttttgactccagtgtcacaagaaagtggcagcatagtcttagaataagggctccacagccagctggctgctcggccaggccttcctgctggcattctagaagcagcatgcagggccaggcacctactggggagctcagtaagcctttgtcactgctgacatgaaatacaagagttggtaagtttctttggttttgttttgaacaaactggcagatagttcaaggttgtccttgtaagtctctctcacttgcattcagctatacattgtttagtaggaaatgagtatagttcagctagttcacttatccccatgccaaaccagcaggcagcctcttttccatgagagacagttataattttgaattattgtaatgctgtacttgcagcaaactcggtgtgtgtgtgtgtatgtgcacacatggctgggagtggggggtagtgccaaaatgttggttctatggcaaacaacaacaacaaaacaaacaaacaaaaaaaccggctgtgtatagctaaaaaacatggccaagaaaaaggtagaatagaaaacatgttttattatcctgatactaaagcctggcagagacacaataaaaaaagagaattttagaccaatatccctgatgaacatcgatgcaaaaatcctcaataaaatactggcaaaccgaatccagcagcacatcaaaaagcttatctaccatgaccaagttggcttcatacctaggatgcaaggctggttcaacatatgcaaatcaataaatgtaatccatcatataaacagaaccaaagacaaaaaccacatgattatctcaatagatgcagaaaaggcctttgacaaaattcaacagcccttaatgctaaaaactctcaataaattaggtattgatgggacgtatctcaaaatagtaagagctatctatgacaaacccacagccaatatcatactgaatggcaaaaactggaagcattccctttgaaaactggcacaagacaggaatgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccatcatctcagcccaaaatctccttaagctgataagcaacttcagcaaagtctcagcatacaaaatcaatgtgcaaaaatcacaagcattccgatacaccaataacagacaaacagagagccaaatcatgagtgaactcccattcacaattgcttcaaagagaataaaatacctaggaatccaactaacaagggatgtgaaggacctcttcaaggagaactacagaccactgctcaatgaaataaaagaggatacaaacaaatggaagaacattccatgctcatgggtaggaagaatcaatatcgtgataatggccatactgtccaaggtaatttacagattcaatgccaaccccatcaagctaccaatgactttcttcacagaattggaaaaaactactttaaaggtcatatggaaccaaaaaagagcccgcattgccaagtcaatctaagccaaaagaacaaagctggaggcatcatgctacctgacttcaaactatactacaaggctacagtaaccaaaacagcatggtactggtaccaaaacagagatgtagaccaatggaacagaacagagccctcagaaataatgccacatatctacaaccatctgatctttgacaaacctgacaaaaacaagaaatgggggaaggattccctatttaataaacggtgctgggaaaacgggctagccatatgtagaaagctgaaactggatcccttccttacaccttatacaaaaattaattcaagatggattaaagacttaaatgttagacgtaaaaccataaaaaccctagaagaaaacctaggcaataccattcaggacataggcatgggcaaggacttcatgtctaaaacaccaaaagcaatggcaacaaaagccaaaattgacaaatgggatctaattgaagagcttctacaaagcaaaagaaactaccatcagagtgaacaggcaacctacagaatgggagaaaatttttgcaatctacccatctgacaaagggctaatatccagaatccacaaagaactcaaacaaatttacaagaaaaaaacaaccccatcaacaagtgggcaaaggatatgaacagacacttctcaaaagaagacatttatgcagccaaaagacacatgaaaaaatgctcatcatcactggctatcagagcaatgcaaatcaaaaccacaatgagataccatctcacaccagttagaatggcaatcattaaaaagtcaggaaacaacaggtgctagagaggatctggaaaaataggaacacttttacactgttggggggactgtaaactagttcaaccattgtggaagtcagtgtggcgattcctcagggatctagaactagaaatgccatttgacccagccatcccattactgggtatatacccaaaggattataaaacatgctgctataaagacacatgcacatgtatgtttattgcggcactattcacaataacaaagacttggaaccaacccaaatgtccaacaaagatagactggattaagaaaatgtggcacatatacaccatggaatactatgcagccataaaaaatgatgagttcatgtcctttgtaaggacatagatgaagctggaaaccatcattctcagcaaactatcgcaaggacaaaaaaccaaacaccgcatgttctcactcataggtgggaattgaacaatgagaacacacagacacaggaaggggaacatcactcaccagggcctgttgtggggtaggaggagtggggagggatagcattaggagatatacttaatgttaaatgaagagctaatgggtgcagcacaccaacatggcacatgtatatgtaacaaacctgcacgttgtgcacatgtaccctaaaacttaaagtataattaaaaaaataaaataaaataaagaaaatatgttttattaacaaacagcatattttataatggcggtgatcaatatttattaaacacaaggttctagagggctcttctggtaggataattctaagaaagaggttccagatgtcaacttacatattcccttataaaacacagccctggcttacacagtatctggtgtacatgtctcttctctccaatgaactataagatctttgaggtaagggttcagtgctgcaccactcagctacactaatggcaatgtgcacacagtgagcactcattaaatacatcagttacagttcacttgcagttgcttgcttactaccaaaaaccggggtcaatcattataagcattcccatccaacacccaatttgttgcatggggaatgaacttcagtttgggtcccttgctattaaagcactcaatacccattatttgtttgcatttatgtcgaactcatagatgcaggatctgaaaagttaaatgaagcttaacataggcatccaaataaaattaattagaatttatatctcaactatttctaacagagtttgagtaacaagactcaacagaaggaaaacagggtaataacagagactaagagggaaaaaaaggaaggcagcagggagtgaaggctggagaagagaagaaggaaggaaaagaaggagggacagagggtggaaacatctatctaagcaagagcttcttcctcaagtcaaaaatttctgcaaaaaacaacatctttttggacaaatttacatgatgcttctaacatctgctcattgtgaaaaatgcaggataaaaacctacaaattcagtatttttagtatttttatctaaatttatatttcatcaaaacaagataaatttgaaaaatattaatacatatataggcaagacatttccttactttgcggaaatatgctcacataaataatccattctttgccaaaatagagcccttccaacacctgttccccaatctccaaggcagggtcttggtccatgggttagaatcactaaaacacacaaaatacaaggaaatgtatctattaagcaccatttggattctaagatgcaagtaagaaacctaatttgaaagggcttacataataaaggtggtttgctggcacatgcaaatggaaagttcagcggcttcaggttgagtttgagtcagttgctctatgatgaaaacaagggcctattttctctctcttttttttttttttttttttttttttgggagacggagtcttgctctgtcgcccaggctggagtgcagtggcatgatctcggctcactgcaagctccgcctcctgggttcacgccattctcctgcctcagcctcccgagtagctggggctataggcgcccaccaccatgccccgctaattttttttttttgtattttttagtagaaacggggtttcaccatgttagccaggatgctctcggtctcctgacctcgtgatccgcccgcctcggcctcccaaagtgctgggattacaggcgtgagccaccgtgcctggccaataagggcctattttctttctttctacttcgtcaaccacatcctaggggtagcttccctcgtgacagcaaggtaactccagcagccccaagcttcatgtcccaaacatccagaaggacacagagagagggccgtcttggggaggtctatcagaagactgaagagccttcttcccaaagtcctcagcaagcatgctggtggcctgcacaggtcacatgcccagccatgaacaaacctcttggcatgactgccactgggttaatcactgtgcaacaggtgtggggtttacctgactgggcttaaacaatcaagatccatccctggagctgggggtgggaccaatccttctcctaccagaagacagaaacaaacattccctgtttcctatggaagggactggggagggagggagaagagacattgtgagaaggggaacaattagaatgccctccacccttcacctggcactgaatttgaccctgtgattcccagtatcaagggaaaatatggaaatgtattttaagtgacactatttttatcgtttaacaaagacaaatgtttattcttatacagagataaattcttttgaagggaaacccaaggagaagaatgtcttggaactgtgtttaagagaaaataggtaaagcaggaggcttagtttggaaagatgcagtcacactcaataggccattccttttttttttttgagacagtctcttgctctgttgcccaggctggagggcagtggcgccatcttggctcactgcaacctctgcctcccaggtttaagcgattctcctgcctcagccttccaagtagctgggactgcatgtgcatgccaccatgccaggctaatttttgtatttttttagtagagatggggggttttgccatgttggccaggctggtcaacaggccattcctacatggatcctccagaaggcagagcatgggacagtaaatcatatcataatccagtgaagttactttggcagagggctgagatgatatagctcagatgctttcccttcaaatcatcgaacttactgcaaagagtagtaactcacatatcttagaaccccttttttaatgtttatttttgtaggtacatggtaggtatatatatttatgggttacatgagatattttggtacaggcatgtgacgcataataatcacatcagggtaaatgaggaattcatcgcctcaagtatttatcctttgaattatactgttatttgtaaatgtacgattattttctacaatagtcaccctgttgtgctggcaaatactaggtcttattcaatttttttgtacccacgaaccatccctatttcccccccgtcactcaccctactacccttcccagcctctggtaaccatccttctactctgtatctcgataagttcaattcttttaatttttagctccaacaaataactgagaacatgcaaagtttgtctttctgctcctggcttatttcacttaacataatgacctccagttctatccatgttgttgcaaatgacaagatctcattcttttgtatcgttgaatagtacttcattgtgtatatgtactacagttttctttatccattcatctgttgatgggcacataggttgccttccaaatcttggctattgtgaatagtgctacaataaacataagtatgcagatatctcttcgatatactaatttcctttttgggggtatatacccagcagtgggatggctggattgtatgatagctctatttttagtttttagaggaacctccaaactgttctccacagtgggaaattacattcccagcaacagtgtacaaggtgtcccttttctccatatcctcaccagcatttgttacttattgcctgccttttggataaaggtcattttaactggggtgaggtgatatgtccttgtagttttgatttgcatttctctgataaatgatgctgagcactttttcctatgcccgtttgccatttgtatgtcttctgagaaatgtctattcaaatcccttgcccatttttaatgggattattagatttttttcctatcgagttgtttgagctctttatatattctgattattaatcctttgtcagaaaggtagtttgcaaatattttctcccatattgtgggttgtcccttcactttgttaattgttccccttgctgtgcagaagctttttaacttgatgtgattccatttgttcatttttgctttggttgcctgtgcttgtccaggtattactcaagaaatctttgcccacttctgtttcatgggtctatgtgtctgtttttatgccaatatcatgctgttttggttactataactctgtgtataatttgaagttaggtaatgtgattcttccagttttgttctttttgctctggatagctttggttattctgggttgtttgtggttccaataaaaatttttgaattgttttctctatttctgtgaagaatgtcattcatattttgatagagattgcattgactctgtagattgctttgggtagtatgaacattttaacaatatttattcttccaatccatgaattagaccccttatgtatcatatttataaaagtaagctcaagcactttaaaatcatgacctctagagtgttttaaattactgtcattatcagattatcctctgagtgtgcatgtgtgtgtgtgtacatgtgtgcacctgtcattatttcaaattttaaaatatttgagtgctactagatgctcagctctaagagacagggtacaaggaggaagagttcaaaactatagttgtctctgccctcaagaagtgtaacaactactactaccatcaactggataaaattataggatgtcaggcactgtgctttacatttattttctcatttaatttgatcctcacaataaccctatgagctaaatatcaacttgattttccaaattgggaaaccaaggcttgaatggctaagtcatttgactcagtcacacaagcaacaggcaacagcaaggattcaaagccaggtactcccaattccaaagcctagattcttaaccacagcacatctggctgacaagaaaacacaaacatccattaagggtgaggagtagaaagagtatatttacagtgaagagctaagtcctgagatatggagtaaagtggcttaggagaaatcaaagaatgcaaatagggtgaggaggagccacatacacagctgttagctttgtgaaccctgtgaacactgatgcctaactgatcaaacacaatctgtctgctggcctctgacccatgatctactagtgtactatgtctttagccactgacagaatggaaaaccaatgacgttttgacaggccttaagacctttcaaagttatctccaaggatggaatcagctctttccctgatgtggacagacttctattctgttctagacataaggccatatatggaggaagtttgaaatcctctggccaaatactagatagtacttccattgtttaataattaagtgatttttataaccctatccctaagagcatatggcaattgtctttgcccacaggatcaactgtcactaaccttttagcttggtggaaaaagctaaatgtcttataatgtctaaaaaaatgtaataccacttcctctgtgcttgtctccatgtaccaggaagtcgtgggtctaagtggatgtggtgtccctctcatgcctcagcagtccctttacaaagcagcagacttctgggtacccaggtcggggcagacctcccaaccttcagggtatgcttctaggttcccagtgctccaagagagggagaaatacttcctctataaaataatggggagtcagaggcatatgggatttccctttgcttccatgaaattaggagaaagcaccaacactttctagtaattccacagtgaataggatgtgctaccagcccagcatcagtagggcttctcttcattctcaagaagtgtaattacctgacgtggctgcctggaattaagattgccgctatcaaggtaataagaaacagttccattcttccccatgagccaattattatcagggtcacatctggaaccttggcttcattttcccgattcaatccatatttgaatgaccactatggaccaggttctatgctaacatctcactgactcaaacagtcttaggaaatggatattatttctgtcttacctatgtggaagctaaataaagctcaggaaagttatatcttttgtcacagagctggacaattatagttggataccagactgaatctcctgacactatgttctgggctgactccactatgtgccactgactcccgtagtgctgaggtttggggccttataatattattattataataacaatacatgggatttcaatggtcatcctcataatcaagctcttactctactctcaaaggagaaagaacatatcatgttgaagggggctattagaaggcaaatgtggtaagtgctgcaatgaatggacacaagcagtttagaaaccctatgacgaggatcaactctgactggagtgaggatgaaggaaaacttaagagatgtgaagccatccactggggaggagatgcttttgaggttaacagaagctcttaaacacagagttggaagcaggcaaacactaagggattcgtggaccacctcttacatcagggtttctcaatctttttattgacatttagggctagataatcctatgtgctggggggctgtcctgtaaattgcaggatatttagtaacatccctgactagatgcccactagatcccagtagagcacactgtccccaggtcatgacaaccaaaaagtctccagacactgccaaatatcccctaggggacacagttatccctagttgagaaccagtgcctttggtgaagatgtgccagaaactggggattggctaaatgcggaggctggggaggtgcagagcaagaacaggaagccatgaaccagataggaaagagggacagatgtgtgactcaagtcctctcagcaactccctcaggtatggactctgactaccttaaagcaaacggagggtcaggcacagtagctcacgcctgtaatcctaccactttgggaggctgagccagcaggatcacttgagcccaggagttcaagtctagcctaggcaatagagtaaggccctgtatctgttttttaaaaaacacatatttaaaaaaagacaaatggaggcaaataagatcccatgatgagggccctttgatgaatgtccagtaggaccctgattgggagtaggacatttataagtggagaggatggattctagacccacgcagcttggaacagaaaaacccttactctctttctcctttcagtaaatcaaagaaagagaagacaaccagggggaatgctaatagaatagtcataatgaacctggaattcccacgcccatttgggaggattggagaggaactggataaggagaaatactgatgtgtgttgtgtctgtgactgcagtgccatccttaccttctcggccatctcctattccctcacctctcacccttggaagggttttggcccaggaaaagcaaaaggagttgggatacttacttcagggagggaggaaggaaagaaaagaagggagtagagatgagagaattctgaggttcaaaagatatctattgacagtgttcacaaaaaggaccatgtttcccagtaaaaagaaaacaaggtaaagctgaggctggggatgggggttgaggaaagggaaggggcctacaagtaaatgtttacaaaatgcccactgagtgtcaattctgggcaaggcacattgcatgagtcaccaccttcaattttcacagcatcatgtaatacctatatatgaagtggttataacaagctcctttctatagagaaggaaagtgaggttcagaggcatcttcacagactgaggggactcccagcgtggccaggggcttgtttggcagactcctccatgctgtgcctcctcacacttcagcacccacagcctcttgcctcatgcaagctgtagctgcctgcttgtctgtttgctctgcaacattagagcagaggggctctaatctgtgtcaggtgctgtgctttgagttctgtgactctagtatttccttatgtgccaggcacaggccccagtgatacaaagaagggagcaagagttaacgctgaggtgaacaaaggacccatggaagcccagctgtgtgaatttacagcacaactaatgagcacacccagttacataactgcctctcctgctctgctcctatgctcagcagccactagaggaaagcagggctgtctttcttttcctgtgctatatataattccaactgtttgggcagggaaatgtgctacagctccacagctcagttacattagatcttaattttttcttaaaaacctagcaatttctaacagtgatgccacaaagataataatacagtaatcttaagattgagatactttacccacatttcctgcacttttctaccttgaaaacactcattatttctggttccactttgagaagcagcaagcaaggaaagggtgaaaatgtgagatgctgaagagacagcttgcaacattccataattacagccttcaatgctggaacctcaagtctccaatatcaaatggaacagtacttccccttggtatctaactaggagctgatccattaaccaggaatatatttttgatatagagtaggccagttttgtttctggttcttttgcatctcctttcctaggccctaaacacagactccatgacctcatgacagtagaatgaatgctgcataaagagaatcattcattcgtcctgggacttcactgaagatgatttttgcttagtaagcctcttcttcagatataatactaaaaggtatgttttctgagacctattaaagcacacatttactaaaatttacattaagttcatgtcagtcctaaaaggttctctaatttctgaaagccatagtctgttattctaatgtgaattgttacacacacatacagacacaccttgaacattttaaaattacatttatttaagcatactcactcactcatactttttgccaatttggttgggctttcccctaaaccaattcttctaaaatggtgagactttaacaaataaaatgatatagctgatattttcatagggtaataggttaagaagaaaaaaatccaggcttttgaaatactaattgtattagcattaatactaatacctaggccaggcgcagtggctcacacctgtaatcccagcactttgggaggctgaggcaggtggaacacttgaggtcaggagtttaagaccagcctggccaacatgaggaaaccccatctctactaaaaatacaaaaattagccaggcgtcgtggcacatgcctgtaatcccagctactcggaaggccaaagcaggagaatcactcgaacccaggaggtggaggttgcagtgagccgagactgtgccactgcactacagcctgagggacagagcaagactccatctgaaaaaaaaaaaccaaacaaacaaacaaacaaacaaaaaaaactaatatctaaatattagcagtactatgatttatagacatgaactcttataaagagtatgtatatggctgggcatggtggctcatgcctgtaatcctggcactatgggaggctaaggctggcagatcgcttgagcctaggagtttgagaccagcctggacaacatggcaaaaccttgtctctacaaaaatacaaaaattagatgggcattgtggcgtgcgcctcatgcctgcagttccagctacttggcggggctgagacaggaggattgcctgaacccaggaggtcgaggctgcagtgagccaagatcatgccaccgcactccagcctgggtgacagagggagaacctgtttcaaaaaagaaagacttgcttaatactgggcagctcagttatagcaagtactagtcaagggtggcatgtcactgtgttcagagttggatgaacctgggttctaatctggactcagctacttcctagtgtaggtcatttgggtcttgggcaaagtattgaacctcccaaacctcagttctcttttgcacaatggaaatcatctgaatatagacaagatagggcccactataaaaattaaacaagatagtctgtgtggaagtatctttaacaggcattaagtgcctgttaagtgtctttaacaggagaattaagtagcatgttcaggctttttgcctccttcctcttcccctccactccccagtgaccaacttgcaccctgagtaaggttttgcagcaccatccttctcctgtggcttgtaaacctctgcagtaacttcagcaatctacactgcctgcaccctgccctccctgtatgctcccctgaatcacaaccatatttgcctttctagagcacatatcattgtcttcagtgattccctgcaggacaaagtctgcccacttcagcctggtatcatgatcctgtcttagtctggtccaacccaccctttctgaacagttccttacaaacccacatcttcctacctcaactctgcctaggccattcccctgcttcaagctcttacagagcctcccatggcctacagtataaattcctaactgtttcaggtggcatttgagaccgatggtatcaggtccctgcgcctctccagtttcactgtctgctactcgtttccctccttatactttacacccaagcgtaaatctacttatagtacctgaaaccccatgctgggtcatcactcttcagctttacatatactcctctctttgacgagaatactcttctcatccatttggcaaattcttcaacagacttcaaacctctctcaaatgcctctacttctgtggtacagtctgtccagaactgtgtcttgtacatttttctactactttgcacctgtgcctgtcatacaacgatttctccagtttctccggttttttttttgtaattcactgaccattattaatgtcttctctgctaaaagtataacaacactcagctttgcacagagcagttacttgggaaatgtttgcattgctgaacacaggcagcttccaatctcatgggaacatcaaatgaaatgcagaggatacatgctatacaacacagtcaagaggactgaaagcaggcagcaggagaattccacaatattcctgtttaaaatgttaaaatgttggtggctgccagagctcaggaaaagaaaatttttttatgtggttacagctcactctaacgagtcaattacattgacctaaagcccatggtgctcaaaactgtatttctctctccaaaacctcattcttttataaagctccctcctctgtggaatgaatgtgggcaatcgcttttgcagtgtttgacgatgccagtttatggctatgtttttctgttcactgaactggctcatttcttcaggagaacaaactgttctccactgaagcaggaattggctgggttctaacaaaaagatttttcccccctgacagtgtttttgcaaaagacccaagtcaatttatagccaagtaacaaaaggtcagaaaggttagtcaagcaatgggcgtaattcctgtgtgtcacagccaataaaggaaatgggtggggataaatagtatgcaattttaacctgaaattatttgtgcaaaactattcttgtaaactatacaaaattacccatgacttccactatataggatttctcactctgatttttttaaaggtacatttactttggaagaactgagatgacctcaaattcctcattcacaaatggaaaatgttaaaaactttcttcacactaatataagaaaaacttggtcattgttttgcagccctgaaacagaattgttcacataaaaaaaaaaatctcatagttaagtcacaattaaatacaatttgcatgactgaatttaaaataaattgcaaaattcccttgccaaaagggaaacaacattgaccaaaaggataggtcaagaaaagaccctacaaaagtgacagttcctctgttttaatcatgctaaaagtataacaaactactgcattattcagtgagcataagaacaagaaaagcctgcctttaaagcagacacgaagaactgacatcaccagccaagcaagcggaaggcagatgagtaatagcctgcactgggcggccaaccaggcccaggcccatcagtctgtggagtaagaaagcctttcagatatcaaggtcgttgggaggcctccttcccccagttctccaatacaaagtctaatctactcaccatttaaaacaatcttagcatccaaaagatgaatggttaaatagaaccctgtcaccgttcagacaagatggtctaaacccatttctctccccacctccttgtaagcacaactgtaaatcctgaaaataacacaaaaggcaaccaaaggagaagtctgaaagaaaaaggaaggtgaattacttagggacccaggattggaggaacaacatagcagcacatcttatgaccacacccccattcaatagaagaaggtggccgagggtgtttcccaacccccaacctagcaacagagggcagcagaggattgaatgggagttctgccgacaataccaagccagctggaagcaccaacaagggggatagctcaggaccccactaacaataaagcagtctggggaaacacttttccccccaactacagggcccccaggaagcaagctgcatcccagcaggatggagactccctcctctacctagatatcaggcagcatggcctggggaaactccttacccccatcagacagcaccaacagggactagtgggagccgtggcagcaccagataaaccaagtggaccaaaagagtactgcaaaggctctgaaaagtaaatcatcgttggaaccacaagagtaaatcccagctcacatgctgcatctaaacactgtgaccgcctgctaaaatggaagatttaaataggacccagactctcttaatagacaaaatgtccgaagtagattttaaaaaatcacctgttggccaggcgtggtagctcatgtctgtaatcccagtactttgggaggctgagatggtttaatcatttgaggccaggagttcgagaccaacctgggcaacatggcaaaaccatgaagatggactgaaaacagacagaacctccaacacttatgaaacaatagcaaaagatccaatattcatattatcagagtcacaggagagaataaaaagaagggctgaaagagtattcaaaaagataatgactgaaaattccccaaatttgctgaaggacataaacctagattcagaaggtgaacatatcccaaataggataaactcaaagaaatccacactaagacacatcttaattatatttctgtaaattaaagacaaagaataactcttgaaagcagagaaaaacaacatactacctataagggaatatcaagcgacaacaggtttcttatctaaaaccatggaggcctggccgggcacactggctcacgcctgtaatcctatgactttgggaggccaaggcaggcagatcatttgaggttaggagtttgagaccagcttggccaacatggtgaaaccccgtctctactaaaaataaaaaataataacaaataaaattaaaaaataaaaccatggaggccagaaggaagtggcacaacatttttatggttaaaggaagtttttcaaacagaaaggaaatgattaaaagaattctgaagcatcaaaagggaacagaaaacaacagaaaaggcagaaatatggggagatatatatatatatagattatcctcctgtagtcccagctatttgggaggctaaagcaggaatattgcttgagtctagaagttcacttctaccctgggcaacatagcaagactctgtgtcttaaaaaaattaaaaattaaaagggggaaggtaaagggacctgaatggaaatcaggtttccacatttcactcaaagtggtaaaatactgatcatagtagactacagtaagtcacataggtatactgtaatactcagagcaactgctaagaaaataatacaaagaaatacactaaaaaaactattagaaagtcaagataaaaacctctcaaaatgttcaagtaacccagagaaagacaagaaaagaaacagtaaataataaatggcagattaaagctctaatatgtcaataattagcttaaagataaatgatctaaatacaccaactaaaaggcaaagactggcagagtagaataaaaatacaacccaactatatgctgttcacaaaaactcacttcaaattcaacaaaatagttaagctaaaagtagagtactgtctatagaatagatagaatagcaatgcttattttacattatgcttatcatttttgatacagaaaaatatttggataagacatgataaataaatacataaatatcctaaaagtgagatacaaaatatatatatatatataacatggctttacactgtatgtaagcaatttctaaattaatacctaaaaggaatgatatcaagatatcactaagggaatctcaattatcttcattattctttcctatgtttttcagattatctacaataagaaagaatggcttttataacttaaaaaatgttgttttttccaaataaagcagtctattcaagataactgtattgctgcctagggaggaggaaatagtctttatcattgctagccaccattaatgtggatctttctactggtgagttggctgtctatacctgccttaccctccaaaagaccagaggcacagggcagaaggcctgaaagaccaggaaatgtcctcttttcagactttgggtatgggatccagggaggaggggctgggagtgggaaatgagaagttagggagcagagggataggggacaggggctagagagaagacagtacagacagtagagcaggactactggatgcctgcctcacttctagtggtttccagagtcattgctctaggtcttcttaggcctcgccactgagctagttcctgtgttttcttaatccatcacctgagaccatgtgagtacgtcttagtcccctatggcccaacagagccaaacccaggtgtcatcccgcgatgctggtggccacagcccagaagaggaaagtcttcattttatactgccaagtaagtctaactgtaacatgcccatcttatttttcagtttctctctaactttatccaggagtcttgtgacagccttcctaccatataacatgcccaatcccttttctggcattttaagtaagaaattctaaagtaatcttcagttcttcctcacccattacttatatatacaatatattattataaaggagacaacacagaatatagaaggcagatttctaaggtcccctattagaggtttataattcttttataaaatgttatcttttctcttcctcaacacaacaaacgaaccccattaaagtcaaaactgaaaactctggccaggagtctgttatatgtaagatgcctccttgttgatgttgctatagtcctaattaacagtcgacaggacatttcaagacttctcactcttatcaccagtcctggaaaagttgtctttttctataactgaggacatggaatcccatctctagggccacacaggataaaccaaagccaaccttgaccttaaggaaatttgtaaggactgcaggactattttagtgcccccacccttgccatctctcatggtcaaagtaccaacaagaagaggaaacacaattttgcaaatactttagcgtatattatttgagaccacattcacagttaaaataagcttttattttacctgttgtcttggtttttgggactacagtaaaaaaaaaaaaaaaagtatggacttggagtaaaagtgtccctattacttattagctgcatagctttgtagcctctttgtctataaaatggaaataattatgtatatcttttgtgaggactgaataatgtatcacttataaaagttccaggtggtctcctggttccatttaatattcctaccttggtttcttttttccatctacttctcatttatgttttcttcttgtattttatggaccagagtgagtcactttaaattctggtagaacaggatgccatatgaatatacaatataaaaatagtagatattcctctggggagtaggggtgggcactgactgggaagggacatgaggaaactttctgggtaatgataatatccttctaggtgtctgggttttataggtgtatccatttgtcaaaaccaggtccatatacagttaagatttaactacaataaaatgcacacatcttacttccaaagaaaaaacctataaacaaataattacctctacttagcgataaaacatgctgaaatagtgaggggggaatgcatcgaaaatactatgacagatgactagatagagggaaagcaaaatcagtaaaatactgatggctgaaaactggtagtgggtatatggttgttcatggtaataatctttcaattttgcagtatgtttgaaatttttcataataaaatgttggaaaaaaattcctaccaaaaaaaatggaaggtactcaatacttgttagttctcagccaggcgcaatggctcatgcctgtaatcccagcactttgggaggctaaggcagaaggattgcttgagcccaggaatgtgagaccagcctgggcaacatcgcaagaccctgtctctactggaaggagggaaggaagagaggaagaaaactttaatgccatgagggggacactgcaaaaataaaaataaaaatacttgttagttcccttctcaaatcctatccctattgttattcatctatttgcttattcacccatcaacacgtactaggcacacactctagcattgcctggtacaagttgcttaaccccagctcctctgcatctcagtttcctcatctatggaataataattacaagtgcctcacaggatttttgtgaggattcagtgagataataaacatgtagcacttagctcagtgcctgccacacagttggtgtttgagaagtgctagctgttattatgtcattatagcatacaataaggagcatgggcatcacagcagattattccagtatcaagtaatgactagaagccctgactcctgactgcttggcttcaaatgccaactctaccacttattacctttgtagctttgggcaaaattcttaagctgtgtctcagtttcctcatctgtaaaataggaataatacatgtcactctcatagggttatgacaaatgcaattatattgcttatattattttgctatatatgcatatatggcttagccagtagctgaaacagtgtaaacactcaattgatgttagcgaattcactatgctggatactcagaggacataatgatgaatgcctaagtccctgacccctcaaggagttgataacgcaggagacaagaaagcaacgtcaacagagggatcacaaagcagcctataatgaatgtgtgctacaggaaaggtactacaatgggcaggcgatacccgagggagactgataatagtgaggaagaccaaagaagacttcaaggggagagtggcattgatgaactgggacttgaagtcagaaaaggggaagaaaaagcgtgttaaaggacatggtatagccaccctactagagtttaataaaaggtaggtcagggtggtttggaagattcatgcctggaaaggtcaaaaggattttgaaaaaatgatatatatatattttttttgacatggagtctcgcactgtcgcccaggctggagtgcagtggcgccatctcggctcactgcaagctccgcctcctgggttcacgccattctcttgcctcagcctcctgagtagctgggactacaggcgcccgccaccatgcccagctaattttttgtatttttagcagagacagggtttcaccatgttaaccagaatggtctcgatctcctgacctcgtgatccacctgcctcagcctcccaaagtgctgggattacaggcgtgagctaccacgcccggcaaaggatcaactattcttacactccaccaggttcgtagagctaagtcttacaaattaattatatcaaccagtaacttttccttgatttttctaagaaataaatactactcatcatttatccactgcactctttatatagagaaacaaagaattcataaccataaccattttaccaacaaggacatatctactaaataatacgtcccagagcctctagaggaagggccagggaagaggctactaacactgtggtagaatcgagtgagttagtgccactctagttgtttcactactttgaggttacaacttggaatctgactcaagaatttaaattcaggaagggagaggtgtccatgcagcagagaagagttggctccctttggccactgccagctggccatgctgggcctcagagattactatgccttggtaaacacatttctgatttctgtaggcactgagcaaactcactaagccttaccaaagtgttttcaacatcacagcctgaaagaagtggctaggacaggggcaggttttgtgattaaaggcaccaaatgctacttcaaaattatgtaaattaaatatataaagtattaatgaaaacatttttcaacactgttggaaattaaaatagtaacaatttatttttacatttaacttcaagggaaaaataaaaagcaaacttattttggtgtaaaccaagcctttttagcagaggcacctttgagtgaggtaggtgtgctggctgatttaggctcggaggaacaatctccttgtctgtgagctccatgaggacagggaccatgactgtcttgcttactgctatgtttttagggtgtaatacagtgcctggcatataactgttgctgagaaatacccactgacagaataagactagtctccagctttgtaaattgagaatttttttatattcattaagagactattcagttcttaattaggtgagggtagaactgacttaataccaactaaactcgatggagacaaattagattttttcccctcatttttagaaggggtatagctttctaggagcctcactattcccgtaatttacccagagctgtcctatcttaatatcaaagcatctaggaaacagaatcactaatcaggttgctgcataaggaacaaatttagagccccttcggaggttttcaacctgtgtatctagcatgcccagccttgcagcaatcagaatgtctgccccaggccaatatggcatttcccttcacggacagagccaggtgtactcagagtcccacactccaactcctcctagactccatgcagacttcccgtctgctgtccctttgcaccattcttcatctaaacatgttataaaacccttagcttttgccatttttaaaatagatttaggtagtggtgaatctggacttttagcgtccacatcatctaaatagtgtacattgtacccaataggtagtatttcatccctcagccccctcccaccttttggagcctccaatgcctattactccactctatatgtccatctgtacccattgtttagctcccacttataagtgagaacatgcataaacctctagcttttaagatttttctgtgtatagtgcttcaggttggctgcttcctaatgacaaaggaaggaccttcaactacaaatgcctccagaagattgtgtggtcaccttcacatggatgtgcaccaattttcaggccatcttggcctcagcagcaaacactgaggcaacatcttcagagaacttaaggctactaagtggtatcttgggacctgtgattctctataaagctggtttggaatttcttttttccagtaagtgcagtatcttgcattgactaattttctgctatcatagcctcataaaatgttcatgaaaatctctcatcgtagctttccactactgtaccctttaaaaaggtctaggaaattaaacatattggaaaatgagcctataggcagcactgtggacagtcatcattcatattttacccacttatagaaggggatttaaccctaagctttctttcatattcttaatccagtttctactcaggtccaaattcattctctaactccacaatgactcttaaaagtgagatagaaaataagatcttgtcaggatttgttttcttttctttctttttttttttttttttgagacagagtctcactctgttgcccaggctgcagtgcagtggcgtgatctcagctcactgcaacctccgcctgccagcttcaagcaattctcctgcctcagcctccttagtagctgggactacaggcacacgccaccatgcctggctaagttttcgtatttttagtagagacggggtttcaccatgctagccaggctggtctcgaactcctgaccttgtgatctgcccaccttggcctcccaaagtgctgggattacaggtgttagccaccacgcccaaccctttttttttttgagacggagttttgctcttgtcagccaggctggggtacagtggcacagctcactgcaacctccacctcccaggttcaagtgattctcctgtctcagccacctgagtagctgggtttacaggcacccgccaccatgcccagataatttttgtatttttagtagagatgaggtttcaccaagttggccaggctggtctcaaactcctgacctcaggtgatccacccgcctcggcctcccaaagtgctgggattacaggagtgagccactgcacctagccaagatttcttttaaaaaatcattttgagctaattttagagttacagaaaagttgcaaaaatcgtacagagtttccatatatcctggccccagcttccccagtgttagcatcttacataaccattgtatatttaccagaaccagaactttaatattaatactattaactaaaccaaagaccttattcaagtcgtaccggttttttctaccgatgtccctttactgttccagaatcctattcagaatccccgctgtatttagttgttatttatccttagtctcctgcagcctgtgacagttccttgttctttccttatcattcacgttcttgacaacttttaagagtattaaacagttattttgttgactgtcccttgattcgggtttgcctgatgttttctcatgattactctgaggttatgcattcttggcaaaaataccacagaaatgatgttgtgttcttaatacatcatatcatggggctcatgatgttgatatgtcttattgctggtggtgttggtcttgacctcttggttaaggtggtttctgctgggtttttccactaccaatttatgacctctttctttatagttaattaacacgttgaggtagtttgagatgatgcaaattctttcaaagctttcctgaaggactactggctccctcattcacaaacctgctcactctgcttaaaatttccaagagattagttgatatgatttcccctaactatttctgccacacaagcaactctgattacttttgtttgttcagtgaattttacttttcttctgcttattaaaaaaaaaccacattttcattgtttaaaaaaatataattgtggagctctcataaccccaccttcagagattagcactatagataatttgatgtatattccatatgaaccttttttcctcttttaataccaatggagtcagataccatgagcttaaatcacagttccaccatggactttgggcaagttgcctaattttgtgtgcaggtaattctttctttttgggaggccaaagacttctttgtaaatctgatctatagactctcattctcagaaaatgcacaatatattgtacacacgacattttgcatacaactatagggactcacagactaggttaagaacccctattctatttatcacctttgatccacaattctgtttctggtaatctagcctataaaatacttgcacatacaaacatgtaccaaaaacatttcatgtagtgctagtaaaaaattgggaataatttaaacatccaccaacagggaactggctaaattatgatgactccacactatggaataccctacaaagaatgaagtagatacatgtgaatggacatagaaagactcccatgatatactattaaatgaaaacatttcaggactttgcatgactccatttttggtaagatgaagggagagagggatggagagggagggagaaagaagagaaaaagaaaagaattagggagggcatgaaacctatatatatgtaaatgcatagaaaaaaatctggaaagtttcacaataaacccaacatcaatgactctgggagaataggattatcgggtgaattttattatttatttagtctgtaactattatattatttgaactttttacaaagagtacaactttaaaaaccccaataagatttttaaaaccctcttcataggcaacaactctgaatgaatatagattttaaaatgtttaatgactggcagaaataatttaatgataaaagaataaccaaactgataagaattttgcccagaatggaatgatagttcaagatacacatgacacaaaatcaaagagttaaatgagaaaaacctaatgaaactctccatggatacaataatgtaatttgctaatactcatttctaataaaaatactaagaacaaaaggcatataggtaaagaaagatgatataaaacatctctctaagccaaatgtgaaaaaaaaaaaaggcaataaaagacaggccacttttaccatcttaaatagttttgaagttctggccaatgcagcaagacagctgaaataaggtaggcatatatattgcataggaagttaaatatgttatctacagatgagatgattggacaactacaagagcaaaaatagaaatttttggaagagctttttgtaaggtagaaataaaacttttacaaactgtttttaagagacatcacttgaacaatgccatggggtagatgaggtcacatagtggacacttgaactccagatgtcacttctggaccaaggttaaaattgttctttgttgaactccttaaaaacttgagggaatacaacccaattcccaagatttgcctacttctagttcatcaagtaaggctccaacagcctgaaatctatcactatttgtgtggtccaaatgacaatgaggaagaggttatctctcgcaccatttttccctagaacagtaacaacaatggcaacacaagcaactaacaatggtggaacacacactggacacctttctttctaagcactacaagtggtagttcatttaaccttcacaacaacccttggtagtagattctaattttgcctccagtttacagatgagaaaattgaggcacaaaagaagctaataacttgcccaaggttactcagctagtagctggtagagccaggagttaaactcaggcagtctggttccgggcccatgctcttagcactacacaatcctgttgcctaagaatgcacaggcaaattgtcatctacaggaaagatacaatctatgaattagagttctggaggaaactgaattgaacaaaagattcaaatgacagaaggaaactactttcagcatggaaagacctgaaagaagaaacaagaaggcactcccagggtctcacacatcattagcaaagaggatccctgggacatgacctggaaacatctgaaaacaatgtgagaaggaagagagaaaaaaaactccaagtaaacaagttaacaaatagattacatgaaggggaatctagtagagttattttttatttttttaaataacagaagtctagaaatgagacaatctaagatataaaacctcaaagaagctcagcaaatcagaatacctcaagctgtcatctgtaaacaaacaaaaatgatgccacccccagaccaagtggcctcatcattcatctaccaaactgtttcctagagtggtagtcaaactgcatttccttgcctcctgactccagagggagctgacttaggttgtgtgggaactgagcatgctggcattgctggccactgcccctgaaggaaaacacctcttccacaccacttttctgtatctcctctacttctttctctagcatggatgtggcatttgggcctgttgtgaagactaagccagccatctgaaaaagctctagccaccccatgctggacatgtattacagtgctcaatatgttcaatttcctgaacataaagactgatctttgccaacagccaatcctaaggccttttaatttctgtacatgctgtacttgagggattttatctctcttcttatggctttgatatcctccttggtacaagtgagtctcacacctttatctccagccccaacatctcatctgagtttctgatcaatatttccaactgctcctagatatgttttcctagacattcaacaagtcctaaaataaactttcccctgcttctctgcaaattagtctctgcacccaatccacaccctttatgccactccccaagttggtcagtagttccaccatctatcaccaccttccctaaaactaacaaacaaaaactcctctgaggcatgccctaattcccaatctccaccatggcaggcattggtaattttagattctgccccgaaattcctcatatctcctcttctccatcatcactgctatctccttgctcaagttgttctcacctcttatctggacaactgccacagctgcttaactgatttccctccctgcaggctgtgcttcacatgacagcaagaattatcttcctaaaaaatgaactagaacatggcactcccttgctttaaaccctctggtacagaccacaggatacaaactgaaacttgtcgcccaacattcaaggtgcttcagaatctggccccaacatcccttgtccagcctcatctccatcatctccagccactatcccaagaacagggtgatgtacctgtgcaccttcagacttttgccctctcactttatcctctttctcacaaagccctgctggtacatacagtaacatttagctcccagggtgcctgcactgactcaccaaacaccactccctctctctttctctctctctctgtatccagtacacctgacacatcacatcttttgccattgttggctgatttgcacatcatgccacctcatcaaccttgaaggcagggacagaattgcctttacttttgtatctcctgcacccagctcaggatctgttggctcagagtgagacctcagtggttgttaactaactgaatcaaaaaatagcaaaatacttatgagtaccaggctgaggctcagaagaattaagacacttcacagaacaaacattaaggggtgaaaaaaaaattggagagatagggtagataaggaataggaagagaagatgccaaaaaaggggcaaattaaatttccttatatggaagaaaaggcaagttcttgcttttgctttgattttagtaaataaattcagaaaaatatgtttagcactaagagatttgaaagattgttcacctttaaaatttgtttaaaagctaaagaaagcaaagaatgttctgtaatacagaagacataatggagaagaaacaacaaatacaaaaacaaagaaacatacaatatacagaaaacataatacaatagcaataataaattaaagagtataaattcccatataagatatagaaccttcaaagataagttaaacagacaaaatccgacaacattctgtttgcaagataggctatgaaataatgataatgaagttggaaaatgtaacaaaatcattacataagaaattatagaccacgaaaaaagaatagagagcagtattgctttctgtgctaccgaaaaataaaaataaaaactaaatacacaactaataatcttgagaaacaaacagaagcattagaggaatttttttttttttttttgagatggagtctcgctctgttgcccaggctgcagtgcagtggcgtgatctcggctcactgcaacctctgcctcccgggttcaagcaattctcctgcctcagcctccagagtagctgggactacacgtgtatgccaccatgcccggctaatttttgttttgtattttactagagacggggtttcaccatgttgctgaggctggtcacgaactcctgagctcaggcaatctgcctgtctcagcctcccaaagttctaggattacaggcatgagccaccactcccggctgaggatttttttttaaaaaagaaataaattagatattttgaaattgaaaaccaaaaaacttttgaaggattcataagaaactgacaggagctgctgcctaagagaggggagctatttggccaaggaataacaatgaatgggaaactgacttttcactacatccttttgtattttttaaagttttatatttcaactaaaagttgctgtgaatagactaaaattgatactactggcaagtgcaaaaaaaggaaacataaaattggaaaaacaggacacaaaaagaagcaataaaattgtaagagaatatgtgtgttaataaatttggataaaactaaatagatgagtttttaatcaaaaatgtaaaattctaacactggcaaaaataaaatacctaaccagaccaacatcttttaaaaatcaaataactaggccaggcgcggtggctcacaccagtaatcctagcactttgggaggccgagacgggcagattgcctgagctcaggagttcgtgaccagcctcggcaacatggtgaaaccccatctccactaaaatacaaaaaaaaaattatgaggcattttggggcagaaatcccagcactgtgggaggccgaggcgggtggatcacgaggtcaggagttcaagaccagcctgaccaacatggagaaaccccgtctctaccaaaaatacaaaaaaaaaaaaaaaaaaaaaaagttagccgggcatggtggcacatgcctgtaatctcagctacttgggaggctgagatgggagaatcacttgaacccaggaggcagtggctgcagtgagccaagatcacgccactgcactccagcctgggcaacaagagtgaaactccatctcaaaaaaaaaaaaaaaaaaatcaaataattatacccctaaaaagtagtcaattctttcagtctccaggaacaaatgattcatgttatagaaatcatgccaaaaatggatcaagatataggttatctaattattctactaatctgaccctaaaactggctaaaagaaacggaaagagagaaaactatacacaaagcacacaaagctcactccgaacttacgctcaaaaatttaaaagaatagtaaatagaacctagaaacagatttttaaaatttttatttgtgtcaacagaaataaaaacattcatttgttaaaatctaacacctattcttaattttaaaattctaaaactaataataaaggtatattttcttaccctgattgagtacctatttattgaaccaaatgtcaattatacttcaagggaaaaaacaaactatgcagtcattaaaaataagcgcaaaataagcattttatcatcactattaacacagtatcagaagttccttccaacaaaaagcaacataaaaatgaaggagagacacaaatacaataaaggcagatgttatatatactttttaaaaaatataacaccattgtaaacttataaaacccaaaggaatcactgaagtcattacgataaattttttttttttttttttgaaacggagtttcgcttttgttggccaggctggagtgcaatgatacaatcttggctcaccgcaacccccgccacccgggttcaagcaattctcctgcctcagcctcccgaacagctgggattacaggcacccaccaccacgcccagctaattttgtatttttagtagagatagggtttctccatgttggtcaggctggtctcaaactcccgacctcagataatcctcctacctcggcctcccaaagtgctgggatgacaggcgtgagccaccgcgcccggccgttacgataaatttaaagtgaccacagtcatgatcagtacagaaaaacttatagtattcctggtcctcaagcttgagtgcacatgaaattcattgtgcagctttttaaatgttgatgtccacacctcccccaagacaaattgtctcagagtctctgagggtgagaccagggattagaattttataaagcttctgaggtgattttaatgtgtagccaagtagagatgcccactactatatacttaattacctaaatatctttaaaaatacaaagtaaaaaagtattactattaaccgttcataatattcacaaatgggtagagaaagactgccataaggaacaaatgttcaaaagaagaaacctgagaaaagacatagctcctgtacaaatgtctctagtccactgcagtttaggcaaaaaggtgggcagttaataccagaaccagtggagggggacaagacccatggccacaacagaacaatggtagcaatagataattattctctttccaagtgttactgaggtaggaggcatgtgtgaggatttcatagaggccgaggtactctaggattacctgcatacctgtatgaggtcatatgtaagataaatttctagaaatgctgtattaattgctgagtcagatggtatgtgcctctaaaagtgaaagattaattttaaaagactttaaaggtgaaagagaaaaagcatgacgtgtagaataaacatcatacttcataggtagaagcagagtggcagaaatgaggtaagctggagttagtcaagatggctcagtgtcaccaggtagtaggtacagagactgacatataagaaaactctcagtgattccagttcgcctttgaccttcccattaaccttcccccactgcaacctccagtcatatgcaatgtccccatcctaccagttatctaactccacaggcattgctagggcccacctgttccctctatcctgaccataatattcttctttcaggtcacctctcacctgaaccactgtaactctttttgttaatctcccaatctttctttttttttttttttttagatggagtcttgttctgtcgcccaggctggagtgcagtggtgcgatctcggctcactgcaagctccgccccccaggttcacgccattctcctgcctcagcctcccgagtagttgggactacaggcgcgcgccactgcgcccagctaattttttgtatttttagtagagacagggtttcaccgtgttagccaggatggtctcgatctcctgacgtcgtgatctgcctgcctcggcctcccaaagtgctaggattacaggcgtgagccaccgtgcccggccttttttttttttttttttttttttttaagatggaatctcactctgttgtccagactggagtgccgtctcggctcactgcaacctccgcctcccgggttcaagtaattctcgcacctcagcctcccaagtagctgggattacaggcgcctgccaccatgcctgataattttttttggatttttagtacagatggggtttcaccatattggccaggctggtcttgaactcctgacctcaagagatccacctgccttggcctcccagagtgctgggattacaggcgtgagccaccggcacctggcctaaccctcccaatttattaccatccaaagctttcctagacattagtttaatattttatgtcttttttttagtgtaaatatctaatctgccatttatattcctaaagtggctataaattaccttctagatcaaagagctatgtttgacaatgatttttaagccccgctgtttagcaggcttttaacatacagtttaagatacttcctccacaacattttccctgttaatcattttcaatccaatcacatgatctccaaatctacttaatcctcctaacgtaagcattcttcattcattcacccaacaaatacttactgagcatctattgtccagcactggtttagatcctggggataaagttcttgccctcaatgaggatttcaggcagggaaggtactgggtgtgaagggaaggcagggagacagccaatcaaatttatctacagtggctggatggtgataaatgctatagaaaaaatagagaaggatagagtgattccagggtatggtaaggtatcattttcaattgagggtaccatacaaggcatctttgaaagtttaactttggagcagaaacctgaagaaggagggcagtagccatttggctatctgggagaagatgattccaggcagagggaacaagaacaatggctccaaagcaggaatatttctgggcagactgaagcatggccagcagaccagtgtgatgaagcagtcagtatgagagtgagcactaggagatgtgtacgtaagaaacttgtcttatgacatttttggtttagaggattgatatataaagccactaaacagttttactcaattttaagactcaaagttaaataatgatcaaggtagactacccaagattacgcctgcagcaatccattactgaagcatagggaaggtgcccaccacaagacagaaagttccagaagttacatttgtgggaaaattcccacgggctggtggtccccaggcttgtgaaggaggagagagagatgttgccatggagttgcctaaagaagttgtacagaacttccagcatcacacatcatcaatgactctgcctccatttctttctctccttctaaaaatttctattcagcttactggacaaagtttcttaataatggaaaataatgtaaaagacatgctttatttaaacagcttactaaggcatatctatttcatcaaatgaaggctctatttacaatgattgtttgctagtgtgctttgctttccgtattaagtttagcattaaaaaaagttttcccaatttaaattttaatatgttttgtaactgctttttaatagtctactgtgaatatatgtccatcattaaatacactagatcattttttaaaaggtttcctattccacagatcccagagataagtgtagtgtcacatatattgtaacctgagaatatggcttgaataattggtattcaaattagttttctagtttttcaagtcaatcaagtgtatgttctgcactcaaactaaaagctgacactttgactcaccctgcacatcatagagagacacaacacaggatactcttatgatctcaatggtcaacctataacagattcctatcagatgatcaaagaaatcatcgaagttgtagattcaatgcagatttttagattaatccaaaaaagaatcatttgatcaaagacttcagcaataaaaaacaagggaggagaaaataatgtttaatagcaatgcgaagactaaatataaagacttctgcattacaaagttgtggtaattaatgtagcaagaaacttgtgaaaactcagaagcatgctatttacccaagaaacatactttttccttacttcattgtttttttccagtttccctcttcactttatgcagtcccacaagcatctctaaaaggtcacatgttgcttctgcagttgcatttcagtcctataaaagaagcagcacatcatcactttatgagaaaacattttaggaggctgagttatccaatctcatcagtctcccttcctaattcattcgcactagaactatacataaacagaaaaaccagtgagacaaaggtgaaaaagaggttatcaaaatacaaactagcaatttgaaactattaaaattcctagtagaaataaagcaaactcaatggtctctgataacagatcagaacaaaatctgtaattttaacgctctttccaccaatgagtttccatgtctctctcccagctaagtttgagacagcttggcagaaataatactaacagatgtgttgctttgtaacttcaaggatgtgctattttctgatgttcttccattcgggttttcctggtgtggattctagaggcacaaaaatggctcagactgtgagttccaggccaaggaactgttttcatctctgtctctgaccattattacccctatttcatcatggcactttcggtaaatgaatgagacagtaactatgttttcaacagacaaccagagatgcttcatgggatcttaaaattacttgggaaacagctgtaaaaccactacttttgagttcttatttctttcttgaagaattatctttgattgagatgcccattagcagtaaaatggtcccaaagcgagtataccagaaggtctcagaacttccaacagacgtgtaggcattgtacactagactctagtgtatcatgactagagcatcatgactacgagcatccatgaatgtacacattttttttgcccctcaaaaaaaaaaaaatccctcacccaagtggcttaacttcttaacaccagcatcttatgtctttaacatacacatatctagctttacactgcatcagggattgttctaagatctttaaatacattaatccaatccttacaatgatgctatgaggttgattctatattctaatcacccagataaggaaacttgttaggtaaattacctaaagaaaagcattatgttaaggccgggtacggtggctcacgcctgtaatcccagcactttgggaggccgagacgggcggatcacgaagtcaagagtttgatacagcctgaccaacatggtgaaaccccgtctctactaaaaatggccgggcatggtggtgtgcgcctgtaatcccagctactcagggggctgaggcagaagacttgaacccaggaagcagcagttgcagtgagccgagatcgcaccactgcactccagcctgggcaacagagcgaaactccgtccaaaaaaaaaaaaaaaaaaaggccgggcacggtggctcacacctgtaatcccagcactttgggaggccgaggtgggcaaatcacgaggtcaggagagcgagaccatcctggctaacacggtgaaaccctgtctctactaaaaatacaaaaaaattagctgtgtgtggtggcaggcacctgtagtcccagctactcgggaggctgaggcaggagaatagcgtgaacccgggaggtggagcttacagtgagccaagatcacaccactgtactccagcctggttgacagagtgagactccgtctcagaaaaaaaaaaaaaaagtattatgcactatgctgctgttcatagtcaggggtacctgggcaaatataactgtgcagtaagctacagtctcatccatctatttcactttttctgcttctgtcctggtatgcctaaagtagctcaatgtctactgaattagctcttgaaaatttctccttattaataatttactgagaaacaacttctaattctccctaccttaaacctcatctttgcttattttttgaaaattatcctttgggaggctgagaaaaaggattgcttgaggccaggagttcaagaccaacctgggcaccagggtgagaccacagtctctacaaaagtatttttgttttttgtttttgagagagagtctcactctgtccccaggctggagtgcagcggcactatctcggctcactgcaacctccgcctcccaagtccaagcatttctcctgcctcagcctcctgagtagctgggactacaggcacgcgccaccacacccagctaatttttgtatttttagtagagacggggtttcaccatgttggccagatggtctcgatctcttgacctcgtgatccacccacctcagcctcccaaagtgctgggattacaggcgtgagccaccatgcccagcctacaaaagttttttttagaaaaatagccagcatgatagatattttcctatgcttgccagatcccttctaactttaaaattgcaacacccttactcaaccaaggcattagagttcagttgattggttgattcagatgatgccaaaagctatgggttcaatccactataaaccagttagctttgtttgcttcacatctacagatttttagtctggatggcatattttggatcataagaggaagcaggtaggagtgtggaagacaacatttgctggagaaaaaagtctccaaaaacagcactgactgtgggccagaagcaacagcctcattcataaaaaaaaagcttcataataattggcaaaacacttctagctttctgagtaagacgctcttctcagatcatttgccagaatatagcctcaagctcctccttcgaaaaacaaaacagatgagatacaaataaaaaattaatgtttttcgtttttgcacaggctctgcttgactgatctgaatacaattttcttattcctgacaccaaggtcactgacaataaaaaaaaaattgaaatgattttagaaagtattacaaaaatctctaggagtgtagcttacaaaatcaccagaaaaacttgactgcaattccataagtatgtcttagattcttttacaattcctttaaattttcataaaaccaaaaaattattccatctccaaatagttattttaaacaagctttttcaaattaaatgaaggaaacaatatcagaccaatgtggtctgataaattttaaaacaacccagacccactcaaggtagaagctttaccagtttcaacaaataaaaatgaaaaagtaaaactatattctttaattgttagtttagggagaaacctccttgggatcatctgttttcatgttttcctgtccagagctggaaagaacttcccaatgtacaaagcacatgggttccaacagtcacaaggtaactatgacagcaaagccacagttatctgtgagatcacagaaattatatgatgtaattttaaaaattgaaaattcatataacattaaccatttttaaatgtacaattcagtggcatttagcacattcacagtatcatgcaaccatcacatttaccattaccttacattactgatgaaatattttcatcaccccaaaatgaaccttgtactcattaagcagtcacttctattcctcctcctcctcctcctccaactcctgacaaccactaatatgctttatgtctccataaaattacctcttgtggatattccctaaaaatgcaatcaaacaatatgtgaccttttcggttggctttctttcactctgcataatgtttcaaagttcatctacattgcagcatgcatcagtacttcattccaatttatggctgaaaaatattccactgtatatagatgcacatcttgctcatccattcattcattgatagacatttgggttgtttccatcttttggctattgtgaatagtgttgccatgaacatgagtgtacaagtatttgtctgatacttgttttcaattactggacatataaacaggagtggaattgctgggtcatatggtaattctatacggaactttttgaggaactactacactgtttcccacagtggcttcaacattttacattcccaccagcaaagtacaaggttctaatttctccacattctcatcaatgcttgtaattttgtttttgttttgtttttaaagtatagacatcttagtaggtgtgaaatggtatatcattgtggctttgatttgcatttccttaatgaccaatgacccaggaaatcttttcatatgtttcttggccatttgcatatctttacaaaatgtctattcaagtcccttgcccatattttaattgggttatcttttctgttgttcagttgttaagagtttttcgttttgttttgtttgttttttaacagatttgcagatatctcctcccattctgcaggttgcctttccacttacttgatagcatcctttgctgcaaaattttaacatttgatgccatccaatttgtctattttttctttcgttgcttgtgcttttggtgtgtttctaagaatccattaccaaatccaaggtcatgaagatttacccttatgttttcttctaagagtttatagtcttaactcttataattagttatttggtccattttgagttaattttaatatgtgtggggtccaacttcattcttttgcatgtagataaccagttgtacctgcaccatttgttaaagagattgtcctttccccagtgaatcatcttggcactgttctcaaaggtcacagatgtacaggtttatttctggactctcagttttattccactgatctatatgtctattcttatgcttatacctattttgattattgtagctttgtagtatcttttgaaattgggaagcatgaatactccaactttgtttttctttttcaagattgttttgactattcagggtcccttgcaattctatatgaattttaggatcagctttcctatttctgcaaaaataggtactggaattttggtcaagattgcactgaatctttacatcactttgagtagtattgccatctttaagtattctaatccatggatgtctttccattctatgatgtaattttaaggttattttaaaatgtccttgataaggtgatacactaacttctttagctgtctgtatcgctatggtaatttactaatatcctggagtatgtcacaaatatgaagtttatacttgccattggtaatccaaaattcatactccagagaatgaaggtaaattatgtaacgtctgttttgtttgctttgggctatggaaaaggtcagaacttaaggattttcattttcctgatttataattaagtttcattatcttcagttcccagtagaggaacagagatgcacgaagcttatttgttcactgataagagttaagttgtttaacagacttcgcagaacagtatcaggaactctttttcatgtagttcaaatccccccaaattgattatgtcacattagctacttcgccaaagattttgctcacagaagcttgagagtcagagcttaaagtatcaactgtagttggacagggtgtcggttggagaggaagggttttacaagtctttaaaaatttttggctaaagtctgtgagagaacaatcacttgatattataaaggtaacttgagctggatacaatctgttttttgctcacacatcaaaattagaactgaagataacacaataacccaggaaaaatcactgtggagttttctaagactcgcaattgcaaggaaagtatatattcccctaaaataaatactggttcatttgaaaccagtagattatgagtctgagtgaggggcagtgattgcctcagtagtgatgtttggtgtcaacttttcaaagtttcagtttgcacctcctgtcaatgtataagctacatgaaactcatagtccaaggtgatccagcaacatcagaaaggatcttaagaatcaaactgggccaggtgcggtggcttaatgcctgtaatcccagcactttgggaggccaaggcaggtggatcaactggggtcagaagtttgagaccagcctggctagcatggtgaaaccctgtctctactaaaaatacaaaaattagctgggcgtggaggcgggcacctgttaattccagctacttgggaggctgaggcaggagaatcacttgaacccaggaggcggaggttgcagtgagctcagattgtgccattgcactccagcctgggtgacaagagtgaaactccgtctcaaaaaaaaagaaaagaaataatcaaactgtttataaataccttcagtcagaaaataccatctgttgaaataaaccagcaccaaatcgcaggaaaaagaaatccaattccatatattttgcgatctataatgaaactaaaagcaataaaaatatcatctggcaggtgctcagggtcagtgctttggcagagcatgttagctaacgtaaaatttgaatttctgagtcaatgtttattttttgttttcaccaggaagtttaagttgaagagggcaagggaaaaaaaaataggcccaggcaagaaatggggcccagaaggtaaccaggtaaaaacctgatgcagtgacgcaaaagatagacaacagtccagtgatgacgagaactgggttaggatagacatagggtggactcctgctggctgagtctgatgccaagcaatcagcacagtgagcaaggctggtcagcataacatccgtaggagactcactctcatggcatgagttttgccacaaattcttccagaactggaaagcccttctaacatggcagatggagaggacttcctattctttggtcttaccactgcctgatgagggtcctatctttagggctcacacaatttcccatcttctaaaagtgtcttcaacacgctaactgaatgactgtacttctccctctccatttcttcagctctagttgcactcagttaacctgaactctgtgtgaagattcagaggacagaagaaatacaaaaaataaaaataaatttataaaaacactaaacaaacaaagattcagaggatgggttggatacagaggcagtgtccgaagaaacaggataaaggccacattctctttggttggtggtggcatagaggaaaatgaactctacaaggaatgagataggagaggagatgctgtgccctgtctgtcacagaaagaggcatcctgggcccctcaaacccagagctgagaattcctgttcttagggagtatgctcaatacctgaatgtatgatagccacttgagtctgtgggattttttttgttttccagttatcaagtatgtcccccaaccccacccttaaaagtctgtttttctttttcttttttttaaatgtagctcatgttggaaaagcagtcagggaagtactttaagagtatatcctagtactccttagcctgaagcctctgtaaaagggagcccagataaggcactttgggaaatttgctgcaaggctgctggggagaggaagcgccctgcctcactctcagtatagtcaaggctcagcgttttgaataacctctcggtctcaaaacaactgctgtgatttgatccaatgtggtagtagctctctgggtctctaattgggttccccgagctctctcaatgcttagctctttttttctttctgtaaagggagttttcagttaatttgcaggcctgccgttctgtgcccaagagctgaactcttgaggcgtccgcctgggacttggcgggctcactttagttttgttttctgttctctttgtggtggtcttagttataagcgcctggaaacatgcccttaactgcagggcaagtgcttgcttcacaagccctgctagacaggaaaaaggaggaagaaagcacactggggtttatgacatagctacaaactatcctcaatttttaaatagccaaaacctggacacatcctacatacctgtcagcataagaatagattttaaaaattgtgatattcacacaatagaatactactcagcaagaaaaaggagtatgtttctaacacacatcatggataaatctcaaaagcatggtgagcaagataagttagatataaaataaaatgtggagttctagaaaagacaaaatttctggtggtaaaaatcacaatagaaattacctttgaatggtgaagacagacaagacagcatgaggaaggaacttttctagagtggcaaaaatgttctgtatactgattgggagtggtgtttacatgagtataaacatttgacaaaaagtttaccaggcaaggtggggtgtacttgtagtcccagttgcttgggaggctgaagcaggacgactgctagagcccaggagttcaaggtcagcctggacaacatagcaagaccctatctcttacaaaagaaacaaacttattcaactatatacttttttaaaatgacacaaacatttttgtaacattttttaatggcacgaagtcagttttccatcatgttgcatctacgtggctaatattttgagaaaaaggtatatttttaaagtatttgatacactcaaatatacctctttaaacaaacataaatctcttcaaagtagtatataaatttatattgagttcaattaattcttaagactgaattacacagagaattctctcaaatttctcttgccctaccctccatgttaattttttttttctttttttttgagacagagtctcgctctgtcgcccaggttggagtgcagtggtgtgatctccgctcactgcaagctccgcctcccgggttcatgccattctcctgcctcagcctcctgagtagctgggactacaggcgcccgctaccatgcctggctaattttttgtatttttagtagagacggggtttcaccatgttagccaggatggtctcgatctcctgacctcgtgatctgcccgcctcggcctcccaaagtgctgagattacaggcgtgagccaccacgcccggccccctccatgtcaaatattttaagcatgttttaaatgcagaaagtatagtgtaggggatggaaagattaatttaagtgtggaaaaaaaactcccctgattacaagagcaatacactttcaataaaagcaaactgtaaaatacaaagaagtagagaagattatagctaggggaggctgggtgtggtggctcacgcctgggattgtacactttgggaggtcgaggtgggcagatcacttgaggccaggaattcgagactagcctggccaacatggtgaaactacatctctactaaaaatacaaaaattagctgggtgttgggggtaacacttgtagtcccagctactcgggaagctggggcaggagaactgcttgaactagggaggcagaggttgcagtgagcagagattgtgccactgtaactccagcctgggtgacagagagagaccctgtcttgaaggaaaaaaaaaaagattatagttgggggaaagctcatgtaagccaaaactatccactaccaaaagataagcactgtcaacattctgatgcacatgcacaattttaaccatactgggatcatactgcacatattggtattttttctcacttaaatataggtctgataaacatctctcatgttattgagcattctttgcatcttttattactactgaggttaaatcttttcatgtgattagcggccattcatatttctttgtggaacagcttggcaatttagaaaataatgccaatattttcctgaatatacttattgtagatatatggaaaatacagaagagtataagactatagaggaaaaaattcacataattcaaatcatagaaacaatcactgctgctaatttttacttttctctgcacagtttttttttgtttttgttttgagacggagtctccctctgtcacccaggctggagtgcagtggcatgatctgggctcactgcaagctctgcctcccgggttcatgccattctcctgcctcagcctcctgagtagctgggactacaggtgcccgccaccacgcccggctaatttttttgtatttctagtagagacagacagggtttcaccgtgctagccaggatggcctcaatctcctgacctcgtgatttgcccacctcggcctctcaaagttctgggattccagacgtgagccactgcacccagactgtttattttataacatctttgtaaataaactattgtcttcacccatgattacttccttgggatggactgccagaatttgaatcctgggtcaacgagtatgaaagttttaaaggcccatattgccaaactgcactgagtattgtacaactttgcattccacaagaagtatataagaatgtctatacttttacatccttgttagcattaaattctctttctcatatataatcctcaccccttatatactccccaccacaacccccgctccacacatacacacaaaaacacacttcactaatttgatacatgaaaaacagtatcttacaactttaaatgcattttttttttaactaacagaatgaagtagtttttcatctggttaaaccacctcaagttcctcttctgtaaatagacagctaaattccttgaatgtctgatacttttcagaagtaaccaaaaagtatttgaggacttcttgttcatcataaataatgattaacttagaatgtacttctcccctctcttaaaatgaccaatataaaagactacttattaaaagaatatatattataaaaatacaagagtaataagttcacagcagcacaggataaacaggaaagacaccatcagaatagcatgaggacttctgggccaaagggaggggaaatgccatcaggactgactgaatgacagcaatactaagacgtaaaggaaatttcaatttgaaccaagcaaaagaaggaaactctaaaactgtgaatataaccatagaaccctaggggggaacaaactcaaattcagagataagtgaagctggatgtagaagtagaagtgagcccaggactgtcaggagaataattagaggcctatggaacagctgcatcctccagtgttctcagaaaggctaaggtgtgagaacagctctctgtaataaagtggaggatcagctgtgggggaaccacccacacaggcgctgggactacagaatgaagaaacagcaccacaaatgacaatgcacacacccacccagaaggcagctgactgaatccctggacgtatatccctggtacttagcaggaccagcactcctgtactctgaatttacttctggaagaataattcccacttgtgctgagagaacccactacagttaccactcggatcacacaaagagttctcaatcctggatgcacatcagaatcatctgctgagctttttagaaataccaattgcctgggccccaccgcaatgcaactgaatcagtatttatagagggaagagggatctaggcatttgtatttaaatattctccagataatttaatgtgcccttaagtaataacaaataaaaacagcaaaggaagcagaaaataattgtagtattctctgaaagatctattaagataccatttcaaagatctatggagatactaagggagaggaacaatactaaaaagttattagtggggaataaaaaaacaaagctatgtttttctgtttttttgttttttgttttttttagtagagacggggtttcaccatgttggccaggctggtctcaaactcctgacctcaagtgatccaaccacctcggcctcccaaagcgctgggattataggcgtgagccactgcaccaggccaaaaaaatttcttaatccttcaacagaggtctgaatagcaaaaggggcataaccaaagacaaaagtagtgatttagaagatcaaactgatgaattctcccaaaccaagaaatgggaaatgagaggggaaaggaggataaatctagatgatccaatatgtctaaccctttttttttttaaaggagaggacagaggaaaagaaattaccaaagaaataataggaccaaacagatctgagttaaagagatctgagcattaggttgaaagggtctgccaagtttacatgatgtataacaatattgaaaaaaagtaaatgtaacttggtgaaatttttaaattacaaaataaagttgaaatctaggaacatgctacagttaggaagcatgctaactgtaacaaaaggaaaattgtatttgcaccagacttctcatctgcaatttcggatgctaaaacacaaatgaagcaatttctacaaagtttaaaaggaaaaataattttaagcatagactctcatatatccctaaaactgttacttaagtatgaaggcaaaataaagttatttgggtatatacaactgctccatgaagttcaccactgtgtactctgggggtaagtaggaagagactcaaaggtgtactgtagcaaattaaatttgaatccaagaaataaaagatgacttgggatacaagaagcagtgctgaacaaagaaataggtttaaagctctactccacaattatcgataaaatacacattaggtgaagtgcaattgctaataagaattattgaaagaaaaaagatataatgtagaaaattaatgaaaaactttgaaaaatagctgggagtaggaaagagtagcagacataaaatctttcttacttgcggaagaaccatagatggtaattaaattttgatgcttacagagaaagttaggttcaaataaaaggatgacttcctccaggaactggaaggatggtggtgaatggaggcgagcacaacatgaggttaattagtccacagccatgtcacatatcaccttgcaaacagtgatgggtgtttaaacattttatcctaagtgcaatgggaagccatttaaaagttttaagcaggggagtaacataattgacttatgtttccaaaaagatcactttggctgaaatgtagagtggatgggagtgagtagcagctgagagagaaggcagaaggctattgcagaagtcctgggctatgatgacagtggcccacattagggtgctggcagggaagatggattccctatgtgttacaggtagaatcggtagtccttcttgtggattgggcatgagggacagagttgttaggatgactcccaggttcctgactttaacaactaagtccatgaagatgtcatttaccccaagatgaagaagaccagaaaataaatatatcagcaagctgtcaaaaaaatattaagtaccctttcagtgcttgagctcgagactaatttttcatttaaattctagatcctgtggtatgctgcaaatgccaaaggcaatcacttaacttctcatcttctctaccaagtaacaatcttcctcaaccacatatttttatgcgtatttaacactggagaagtaatgtcttagaggtccattagacacaattcatctttttttttttttttttttgcgaagtctagctttgtcaccaggctggagaacagcggcgctatcttggctcactgcaacattcgcctccagggttcaagcgactctcctgcctcagcctcctgagtagttgggattacaggcatgccccattacacctggctaattttttgtaattttagtagagacagggtttcaccatgttgggcgggctgttctcgaactcctgaccttgtgatctatccatctcggcctcccaaagtgctgggattacaggcgtaagccaccgcacccagcccacgattcatctttcgatgcctctaatgaagtccacctttaaatggtggccaaatatcaagtctaaaacccaggtacgttgcatgaaattgaactgggcaaacaaggaatctaataaaatacatgacatctcatgtctgtttctaacatttcctaaagataattattttgatcagctagagactggtacacgtaataacactaaaaattcactgcataaccaaaggctttcacaactctttattgttttatttatttattcattttttggagacagggtcttgctctgtcgcccaggctggagtgcagtggcatgatcttggctcactgcaacctccgtctcctgggttcaagccattcttatgcctcagcctcccaagtagctgacattacaggcataccccaccatgcccagctaattttgtatttttagtagaaacagggtttttgttatgttgcccaggctggtcttgaactcctgagctcaggtgatacactcgccttggccttccaaagtactagtattacaggtgtgagccaccatgcccggcctcaaaactctttagacatcgccatcagggtgcatgtgtgtgtgcattcacatgccagtgattttctataccctggaaatgagagccctctcctccacatctgtccagctgtggtagagcttcccaaagtccataatgcagggtttcagctctccactaactatgcagttgaatgacttcctataaaaacaaggtcacacaccactaagggcaaaagcaaatgcatctcctggggagacagtcactgaacattaacatcacttttatcgggccaggtgtggtagctcacgcctgtaatcccagcactttagaaggctgaggcgggcagatcacgaggtcaggagatcgagaccatcctggctaacacagtgaaaccctgtctctactaaaaatacaaaaaattagccaggcatggtggcatgcgcctgtatcccagctactcaggaggctgaggcagtagaatgatgtgaacctgggaggcggagcttgcagtgagccgagatcgcaccactgcactccagcctgggcgacagaacgagtctccatctaaaaaaaaaaaaaatcacttttatctatggtcactgtgagtcaaagacaaacatgaggatcacactctccagtctccaacctagactgtccagaacccagctcctcttaggaacagtaatggataattactttcaaaaggtcttgagtggagagaagatgaggagagaagagaaaacctttttactctctgtacttctgtatcttttggagggtacaagtattaatatatatgcattgtgtattatttatgtaattttaaaaaagaaaaaaggaaaggctattaaacaaaaatgtctttttctcaaacctttgtgatagaatgagttagcgtccccagagtaatgagaaaattgcacttgcttcataatgtttcaattaccaaataaggaacgcctattacctaattacttaagaaggaatacagctgtttaccaaataaatgcatttataaacatttgggtacttacaaggtgccaagcagcatgctatcctagactctctcctcttctcaggccactcactttccttgctgatcttctattctccaattgcttcaagtcccatcttacatgccaactatccccaaagccagctttctctcaccacagagcaagctgcccattaggtatctcctcttggatggcccactacctcctaggttcaacatgtcccaaaccagaatcatcatctcccttaggcctgacccactccctatgttgcccatctcagtgtatacccaagtgcccaacccctcacctttcaccagtatccaacaatggccagttctccacttcctaaatcttcaatctgtctgttggtccctacagttacatattttctcaaaggactagcctttctcatcaagaccccagccttgaagctctctgcaatcattttccttactgttccaggtttaatctttctcactaaaaatctgattgattgctctcatcctggaaagttttcgggagcccttcatcaaaccctcagcatcaaatctagggatgttatgatctggatctaagcctttatcacctctccagcctcatcctccaccaaactaaccacccctctctcctaagctccatcctaccccctacacagcatgctctcactagctatgcttcattactttagggtcctagatacaagcattcacttgcctcatagtttttccccttactatctggtacacctttcttcctccatatacttcctctcccatcccttgacttcgtacactcttactggtccttcaggtttcagcgtaaacacttctttctctaagaagctttctctaactacccttgcatctccccactgcaaatactgggtcgatgatccttctgcttgccattctgttttatccctctcatggaacctaacatgctaaactataatttctttttattcctctatatcctcactaaactgtaaattacttgaggtgaagggttctgtctgccactcttctccatggaaggcatttacatcaatattggtatatgaatgccaacttacagaataagcatctctggacaaatcatttacttactgaagccatttcaatagaaccctgaacttttttaaggctaaatattcagattccagaggaaataatactaatgttggtgttaggaagcccatcttctaaatgttgctgctatcacctgtgtggccttcgacatgtcagttaacttgtttgagcctctgtttccctgtttataaaatgagggagctgaactagttcattaaaatctcttttgtttataaaattctgtaatagtaaatgcagcaaggcatcattgtcaaattattttcaagagaagtccagtttaatttactgtatcaataaactgataccatttatcaaaataaagtaatcaaaactgggtagaagaagggagaaaacagtgtagcagttagaagcatgaattatagggtcaaaacttcccaggttcttgttttagccgtgctgttcactagctggtgttatcttggctgtgctacttaataactagtgttatcacagagttactcaactttcatagcatcagtttcttcatttgtaaaagagaaatagcaatagtgcctttcacacagaactattaaggattaaatgagatgatacatacaaaaggtttagcatagtatgcctagtacagagtaaatgatcaataaatgctattatcattttaaactatcagcgaagagttcttatattgacaaggatgagaaacattataatagcatcagagtagtagtcactgttgagaatgcactttcttgaatacttgtaaagtctcttttcaattaaaaatgcaaaaaattataaagacaaatagaaagcacgcttactcattcccattacccaaaattagccacttattattgaaaacattaaaaatactttcagaaagatggctactgtcaagtttatgaattgtatcattgctgcctgactcctaatccttccttctgcattcattttttgtacttcctaaggggttttttagcaatggtcagtgaatgataaacttcagtctttgaaaaaagccatttcactcacactcttgaattatagttaacttgagatctactgatagtttaacttgatatcacactcttgcatggcagtttattctcagttgacagttttttcctcaaagcactttgttccatcgtctttcagccttgattgctgctgtcgaaaagtcttctgtaagtcatacttattatagtcaagattccttgtaattcttatatgagaactcttggaatgttgctactctttccttctctctattcttttcttatctctgctcaaaaccctccaatggcttcccatttcagagtacaaacaaaaatcctttccatgggctaaaagccctgcatgatctatcttccccactcccattactctataacctcatctcttctcttctccccttgattactccacatctctggtaatcacagagttttgctctgtgtccccacccaaatctcctctcaaattgtaattcccacatgtcaaaggagggacctggtgggaggtgattggatatgggggtggtttctccatgctgttctcatgatagtgagggagttctctcacgatacctgattatttaaaagtggcagtttcccctgagctctctctctctcctgccaccttgtgaagatagtgcctggcttccccttccaccatgactgtaagttgaggcctcatcagtcatgtggaactgtgaattaaactgcttttgttaataaattacccagtctcaggtagtatctttatagcagtataagaatagactaatacacgtgaactctgtgctattcctcaaacatgctgctgacttgaggcctttgacttactattcattctgatttgaataacaggaatcaatcatttatcccaggaatccacacctgttccctttatcttcctcagaactctgcttaaatattactgtttagagaggcctcccctgactacaccaccccaagtagcagtcagactcccattctatcattctctattcccttattctgctctattttttctttacagcatgtattaccatttgacacattatatttatttataatatgtcttaccttctgtgttaggcaggctctaagatggcccctaatgatctctgcgtcctggtattcatgcttttgtgaaacctcatctccttgagtgtaggccagacttactgactcatttctaacaaatacagcagatatgatgaaatgtcacttccaagattaagtcatataaagaccatgacttccatcctgggttctgtttcttactttctcttggatcatgccccgaggggaagccaatacaccaagtcatgaggcatccctatagatgggtacttatggtgagagactgaggcctagcaacaaccatgtgagtaagcttggtagtggggccatccctgtcctgaatcaatcctttagatgagactgcaactccaacctacagcatgactgcaatctcatgagagactgtgagccagaggtacccattaagccctgctcagattctcaacccatttctgttacataacaggtatttgttgttttaagatgctactttgagtcatttattatgtagcaatagataatatactctcatgtgtaaaatataaaatatcatgggatgtattaagaaagacaccactctatatgcactgtgatgatataaccagccctttaaaatcaaatttggagtaaagcaaggacttcattttattatttatttatttttgagacagggtctcaccctactgcccaggctgaagtgtagtagcacaatctcagctcactgcaacctccaccttctgggctcaagcgatcctccccactttagccttccaggactataggcacatgccaccacacctggctaatttttgtattttttgcacagatagggttttgccatgttgcccaggctggtcttgaactcatggcctcaagcaatccacccaccttggcatcccaaagtggtggaattacaggtgtgagccaccgttcccagcctttgactttagagccactcattcatgaatttgaaatctccatggtggtagtgactttttgctgaatactaccatcccttttgcctagaaaagttacaggcacacagtagtcacttaataaatatctgctaaatgaatacatggttaaaaattatattctataatgtttattacaaatttagaaaatgaaaagatcttgagatgtttccctaggcaatgccaaaatttacttgaagggcaacacactggtggtgcacaggcagaaaccagcctgcagaagacaaatcttagctagccagaatgatattttgaaaaaaattttatgacaaatagggcccaaaagtttgccatatatgtaactaccactcttgtcttataactaacaaattcctacctttatattatatgtctatgacccctggtctatagttagtcattctccatcactagaggtgttggaaaatagctgcaggcattttcatactataagggtgggtatcctaaattatctctaaagtgactttgaatttcaggactctataatttcattcatttaattgtatgtgttttgcaattatttaatacttagatgttacattgaatagacatatatttagaaactttttagaagaatcagccagttttagacatgctaattaatggaatctaacaaatagttttttctttttttgagacagggtctcactgtcactcagtccggaatgcagtggcgcaatcatggcttccacggcaacctcaacctcttgggcccaagtgatactcccacctcagcctctcaaatagctgggactataggcattcatgtcatgtccagttaatttttttttatttttttgtagagacagggagacagggtctcactttgttgcccaggctggtctcaactcctgggctcaagcaatccccctgcctcagcctcccaaagtgctgggattacaggcatgagccacagcactcagcacaaatattcttgaatatataaccattttcaataattaccaggtcattggtaaataactttgtcaggtgtgttgtttaatgtaactatgcctcccatttctagttcatgaatgagtggttccaaagtcacagtcaaacagagaaaaataacggtgctccttgttttactccaaatttgaatttaaagtgctagttacattattgcactggttacagagtagtgtctccctcagtacatctcattttattcataacgaaggcatctgtcttccttttaggtaacatgccaaggatgcaatcttattgtactaataaaacgtttggctatgtctaccaaacatttgaaaatttgtccatttcctttcagcagctttaacaatgttatttaagactgtcacttttttttttttaacataatccaaggtgccaatgaaagctctctggcccctagattacaaatgccaccgagaaatgatcctgtcttacttggttcatggccatattccaagtgcctagcggaagcctgacaaatagtaggtggtcaataaaagattgctgaaaacatggaaataactaatttgaattatgtaagtatgcacttctatcctagttgtagtttcaacaaaaagaaacctagaaactaaaaactaataataacgccaaacattggggcaacattaaaataagaggctttcaagataaccaatttgaaaggaaagcattcatgtttgacaaagttccattatggttgttagaaaatctgcttagtctgtagtcactactatgaattttattaaaagtcactagaactccacagtcttcctttaaaaagactagctctaaagagaagtaaaagatgagtaacagtttgtgttattgaatgctgattatgtgccaggtactatgcttgaaacctcacacatttcttactatttatttatttattttgccagtacaacagaatagattttatttctcttagagacagggtctcactctgttgctcaggctggagtacagtggctattcacaggcacaatcccactactgatctgcatgagagttttgaccttctttgtttctgacctagacaggttcactcctccttaggcaacctgggggttccctgctcccaggaggtcaccatattgatgccaaactcagtgtggacacccgactggcatagcgtactacagccctaactcctgggctaaagcgatcctcccaccccagcctcccaagtagctgggacaataggcacatgttactgcatctggtcacttgtttcatttaatcctcacaaacattgtatgaagcagaatctgagttatctctgtgtctgatgagaaaacagatgcagagaggtgaagggacctgccttaggtcatacagctactagtatgcagtaggaaggcaggtatttcaacccaagctactgatcttaaccatttggctacgatggcagagccagtttcttaaatcataaaatctccaggacagcttcaaggtctaaatgatcatgtggaaaagtggctacagggactcagttaattagttaccatctcctctcccactttcttcatctgggggcctcccaacctggctccttaggcaatgctaacttgtagtttgggacaataaacagtgacccaataatttgcttcctccctgcctacaactttggggagctttaggatattttaagcaatatgtggtattgtttgatgaagcccactgaaagggaagtaaatatgttgctcaattacaaagtaattggggaagttaaatacattgcctcaggtcatacagctagtaagtgatggagctgagatttgaatccagacatttttccccacacggagctgagatgtgaactcagactttttcccccatgcagtgttctttccacaaccgaaagagaagctgcataaattcaaggtcagtaatccatatagaaagagaagatcagagaacagaagtcacaacaaatcttaaaaatatgtggaagtagatgagaaatgctgccagagaaaggcaaattcaaaatgacacaaatgttgcagaattaggattacggcagcatctctaagaagatgctaacaccatgttagtacaggattggaaagggtggctgcatcaactttttaaatctcttctaacgaagacgcagtaattatgatagaaatgactacactcttctttgttaataattcagcaagcacagagcataagtaccatatgaaagctgtggttacataaataaaagattgatggacaagaatatatatatactatatattttgtgggtttggaatatatgtgtgtatacgtatacacacatacatgtatgacacacgtgtttgtgtatgcatatgtatacacacacagatataagtttatatatgtatatattcaaaacctacaaaagtttttgtatgggccatcaattaaaagtaaagcatgaatctaaaaaaaatgcatttttgagcaatcagggaaatttaaatatagactgagtattagatgatattaaagaactattgttatttaggggtaagttaatggcactctagttgtttttaagttctatcattcaagcctggcaaggtggcgtgcacctgtaatcccagctatttaggaggctgaggctggagaaccgcttgagccaggagagttcaacaccagcctggggaacacagcaagacctcatctttaaaaaaaaaaaaaaaaaaaaaaaagagttctataattcaattactattaatacatccaagtcatttcattttcaatctggattgaatattggcattattgcttattttttatgaaaatagagcagctgaattgtcagtgtcaaagctttggggttttttgctgttgtctttatcctccgattgggacttttgaatttaatgtctagttacaggattcaacttttgtgacacattaggaagacactgtctctaatatttaggaaccagaattatctgaacatattaatcaacagtatacagaactgtcctgtcccactgaccaggtcacaatgagctctacaaaataaacaagtgcaaatgctttgttgtctaaacttctttactttctaaccaatgcttaatagtaatttttttttgaaatgaccaaaaaagtatgggtcacagtgctgtttgccatgtacaaagggcaagagaaaagcacctctcccctaagctaaaagattaaaaacttggagaaaagggagttcaggtgatcacgaactctctactctgtgtttctacagaactcacttgctcatctacgattcaaaagctgccctttgcatgagtacctttcagtttaggaatgtaatttcaacagtgcatccattttatccaaattccaatagagtaagaaaaaaattggatgctccataacatttcttataaaagaattttatcagtaacactgtactttctagccaatgcttaaaaaactgttgactgtctcttttctgtaactttctggtatgtgagagtatctcagattaataactcaaaaaaacagtatacacaaccactttatcagatgtccagatgacaagaaacttgaaaagatactaagtatgttgggtaacagcttgtctggctagaataaaaggtccaattgaacatacacagaggtgtgccaccatttggaagctggcaagacagccctgctgttgttttcttcatctacctagtgagatgggagacgcacgtttgattatagggtgtcaaataccggcatcagatagtatctgctgggggctctgatgggtacagcacagctacccaaataccaaaggatttgctttcatgaacaactttccccaagaactgtgccctgctactcaaaagatgatcagggagacccacaacatcagcacaagcttagagaaaacttgttacaaaggcagaagctctgcctcacccagactttctgaatcagaatctgcattttaaccaaattcccaggtaatttgtatgcacatcacagtttgaaaagcatggatttagaggattattgtcagtttggaaggaggtttccacaaaactcttccttgggcccctcctgttcctcatttttactgatgagtcacataaggatattgaagaaccctcatcaaatcccaagtaacactaaactagaaggaaacaattgcaaaagcacctcttggaagagaccaggcttgacagctgatcacgtaaaagaatataaacaaccagagatttgctaaagaaaaaaaaaagtaaggcacacttgagtatactgctacaaatcagaccacttctagagaactagctataagtctggtcacacattctaagtgactgacagtgaactgtggtcacacagtttggtgagaaacaaggagggaaagggatctggaaattctatcgaaaagaatggctgaactgaaggatcttaaacctgaagaagaggtgacaatgtggggacatcatggtcatattcacacatctgaaagattgtctcaagacatttcattctacaaatgtgtttttgagcatctgctatgtgccaggcaccatgccaggagctaaggatacagagagtgaaaaccagaacagatctctaattttctgatgtttcttgcctaatggaagaaacctgcctgtttttccagaaagcacaactccagacaatcaaaggcaagtggaaggacatgggcaccattcaaggaagccccttctggccagaaggctacagctttgtaaagaagtgaatagacaaaagttccgaggctccccagggctggaaagaatgagttaagaaaggatgaccacctcccagggagtagtagctcaggggactaacaggccaatgctaatattccagggctagaggatgcttggggtcaatgacattaatccaagatttgtttagaattatgctacattcaatttagctgacaacaaaatttttaaaacttaacaatttagaattaacagctaaattttgtatgtaaatgatgtcataccttaaacttatgagtaaatgatgtctaagttctcatttagtaatagtttgttgttgttgctgttttgagatggagtcccactctgtctcccaggctgaagtacagcgatatgatctcggctaactgcaacccctgcctcctgagttcaagtgattctcctgcctcagcctcccgagtagctgggattacaggcacccccccaccacacctgggtaatttttgtatttttagtagagatggagtttcaacatgttggccaggctagtctcgaactcctgacctcaagtgatccatccacctcagcctcccaaagtgctgggattacaggcatgagccactgtgcccagccttagcaatagtttttaaaacctaagatttaataaaaatccacattatttattgattgattttttgagatggagtcttgctctgttgcctaggctggagtgcagtgacacaatctctgctcactgtaatctctgcctcctgggttcaggcgatcctcccacctcagccagaccatacgcatgtgccatcacacctggctaatttttatattttttggtagagataggttttcaacatgttggccagactggtcttgaactcctgacctcaagtgatccatgcgcctcggcctcccaaagcgctgggattatacataggcatgagcccctgcgcccagcccacattaatattttaagtaaaaactctgtattaatgacttatttcaattgtactcttctctcagctatccctcaaactactatatttccagttccttgatgtagcttcagagttgctcattccactcccaaaattatcctaaagaaataattccatttcttcttccagaagaacaaaagagggaggggtggggaaactagttgcctgagatgcaaataaacaatatttataaagaaaaataatacataaaacacttcagtagaatgcaatccttttcatagaatgcagcaaggcataaaaaattaaaaatatataataagacaatatttaaggtaaactgagaaactatcatatataattatgcaggttacatagcaacatggaaaaatgcttacaatgacatgggaacaatacaaacttgtataattctagccatataaaattatgcatgcatgtgatcaaaaagtaggaaaaaagaaaatccaagaattttctagagtattagaattccctttttaaaaaatttaaactttctatttcactgttggctgtacaatacttttataataaatttatcaggagccagccaggcgcggtggctcacgcctgtaatcccagcactttggggaggtcgaggcgggagatcgagaccatcctggctaacatggtgaaaccccatctctactaaaaatacaaaaaagttagccaggcgtggtagcgggcacctgtagtcccagctactcaggaggctgaggcaggagaatggcctgaacccgggaggcggagcttgcagtgagccgagattgcgccactgcactccagcctgggcgacacaacgagactccgtctcaaaaaaaaaaaaaaattatcaggagccaaaataactaactcattacaagtgtaagaatttgtacattcgcaagaaatgaaatagtaaaaggtgacacacacagtttgatcttctcgttcagttggttgtcctttataatgctatttaagttcataaacaaccaaaaagtaaagataatgagattcatgttattaaaagtgcctaacatttgtggaaagcaaaaaggactttgttcagcaactgcccatgaactttgggtaaaagcaaaactaaatttctggagtctattttgcttttcaccttatttgatctcacttaacatcactcatgccaagttgagtttttttcctcttcttttcccttctcctcaagttcataaagtaaaaaaaaaaaaaaaaaaaaaaaaaaaaaaaaaaaaatacatggcagctctgttacagtcctcactgttctcccagcaatactatgtatgaaatgcggctttctggaatgggccacagagaaagtaagataagagaaatatccaaatactacctgtcaccacggggatcaccaggactgagttgacttagggccaagagatctgagctcaagttttccacatctataacatggaaataatactacttgccccaaaaggtgatgtcacaagaaagtccctagcacatggtgatgctcaagaaatgctcatctcatccttttttccccaccttctgccacacacgtgcacatgagctctgcccattctaaaactacaggggtccttaagtctactatttcccagatgcccactccaactttctctaccctgctctctgtcttggcaggctaatcattatgaatcacatcaacaggtccctatgaccttgacctctgattgggtttagccaatgctaagtcccagaaagagatcgggggaggaagggagaagcgagggagggaataaagttgagaattcattctacttgtggcgtatgcatccctcaaccaaaattcactgctcctctcaaggtagcctcttgacacttgataatgacaatctcttctggctcctgataactactttcatccattttcatccatttgtctctttggagctaggggtagtaacagctccaccatcactataaaccctggttcctgcactatcccttatggttttctctacatcctgcccatacctcttgaagtaaactctcttggaattatcctaagttgagaatgccaacttttcctgttgggactctgacagataaagttctgtctatagaattccagaatcatttatatcttgaatcaacacaaggagaatggcagttctggggtttcagattgagatgcacatgcaggcaggatctgataattctaaaatactcccaagtattgatgattcaaaactcccaaggctagcctgtgttcccccaataggcctgagttggtcccacagctgagccattctcctcagaccccagaggaataacatcagcttctaaacccttgggaccctgtgaattgacaagaagttctaggcacccccatgttttaaatcttcagtccagcctcagtcagtgagtcccagttttatctcaaactaataaaggtgtccaaattaccaatctctcagagactgggggaaggggaaacatagcagcctcgcaaacatcccatctttcctattgtgccatggtttcatgtggagttagaaaatagagcacaagaatggactctccaaaaccaaagggttgtgttagcctcggatggagtgggaaagaatatgaagtaacccccctacacacacctttctctcctttccaattcccagagcaagtgaggaaatggggacctagttacccagggtaagtaagtatgtaaggcagagccaggactgaataaaggcaactgactgccagtccaactttaatgacaacggccatattttctcccatttggtctgtgctgtccaggtgtccaaaggcgagttaaaggaaacacccctcagttgagtcctagcccaccataatgtgtcagacttttactggtttaagatgcacttacaaggtctagagtggccctagtcatcctaagactgaagaactcacagaagtttcatctatttctattgagtctaaagatatagagctaaggacagccttagctgtcagcacccgccatgtgcagagggctcttccagatgccctggtgagttaaaaagagtcatccaattctttttttttttatttatattttaagaagaccagagaagtaaatacaaagtacaagagaaaggaactgtacacagagcattacccagcaggaaggcattaaagcagcagcatagtggcacattaggagctcgttgctctgggtcacactgtgacatgtgaaacatggagcatgccccagcctttccaaacctccatttcttcatcattaaaatgaggtcaataacactatccactattaatgacactactattaacacagggttaatgatacatgtagcagtccttagcacagtgagtgacatgctatgagggctcaataaatgcttgcttttataatcagaccaaactgaagttggttaagtctcctctagctggaaatcaaattctacagccttactggcatcttacctgcaccctagggcttaaaagcctttgtttacttttagaggaagtatattacaatattaacaaatgtaacaaaacatagcagtaaaactatgctagtaagatcactgagctagaaatacttcattgaatagatgttttagaacctacattcagaggggagttccatgagagtgggtgtcagccaggagtaagtttagtaagggactgaaccattaaaatgctaacaaaacctcaggataattcattaggatcacaatatgcagactaaggaggaagtttacatctgaagaaaccagggatccagaatctgaagagagggacttgggagatgaaagtgaagaaagcttcttcaggtacttgaagggttgcatatgttatatatgatgggaaagactaaggaagtccagtgggtcaagagtcccaggacaaatattgtggcttcctatgaggaagactgttcttgtgctaaccaagaggtgtcccctacgtaagatgatgagttggcatctcaccagtgggcatactggaaaaccctgtggtcacttcctacctgaaagtctgcaatcctaatgtcttatttggacaccagaaataaacataattgggaatcaatagagtgcagctcctatgtgccagcatttctcaccctgctaacaacaaaaccttcagagaataatataacagctcaaatttagtctgctattacatttacttgggcagtcttattccatttgagaggcattctagttaaaggtaaataacaactctataatgttttttcttaaagataaattaatcagcccaacactatatcaaaaaaggcacaaggataatctgtcacatgattttgagtaattatgctaagggtttcatttaatcaaaggcatcattgcttttttgctctgctaggctcagaaaactaaacattgaaaaaaatcaagaaatattctaaaaatcacagccactgagaagaaagtgattcaacattatattttctttgttccacctgccaaaaatgatagagtgaatttggagctgagaaagacaaaaagaaaaaattcaagagtagaaaaagacatatgaaagacaagcatgaggctaggtgcggtggctcatgcctgtaatctcagcactttgggaggctgaggcaggtggatcacttgaggtcatgagttcgagaccagctttgccaacacggcgaaaccctatctctactaaaaatacaaaaattagccaggcatggtggcaggcacctgtattcccagttactcaggaggctgaggcaggagaatcgcttgaacctggaaggcagaggttgcagtaagccaaatattacaccactgcattccagcctgggcgacagaaggagaagaaggagactcggtctcaaaaaaaaaaaaaaaaaaaaaagccaagcatgagagtttagtgacattaaccacccaaaaccttcctgaaactccagatgtatgatttgtatacctaagcatatagtgcagtctccacccgcgttttctttttccttcaccacaatgagttgggtagcaggagagaaggatataaaggcagaagctcatctttcattcagtctatttgctgcctttgacggctatcacaattcagcacacaagaatgttagtgctcatcaccatggaggcaattgtaatgtcaaacccagaactgtggaatcacaaaatatgagacacatgtaacaggctttgggatgggagggtaggagtggagatccaaattaccaggcaagaaattcaaggcttcagaagcccttttgaagcaattcagattcttagtcatttttttttcctttcagaaaattgagacactgattatttctagttaaattaatctgttcatagaatatattataccagaattccagccttcagacccagtgagaaatgaatgcactattaaaggatatacaatcaagtatagataccttcattataaagtgtggctttcacctgaactggagaaagcaatctttgtcctagatcacgcagtatttcattgtaactctatccctcaagcactactagactggggagacaagtcaacagggtgctaagtgctatcacagaggtaatctactttatgctccaggagaaatggaaaaggagaagtggcacctacccagcccgaggggtcagagaaggcttttggaggaggggcacctgagacgaagctggaaaggcaagtagtgttggcctaatgggcaggatagggtttattctatgcagaggggcacaggggaagccaggaggaccaactggaaacccagaagactggggaatgctaacatttcagggctggcctaaggacttggggaccagaaaggggccacagaatgatgggtcagaaagacagacgggccagaaagacagaagggctaaggaggagggcctttcaaggcagaagtcgctcacagtgtgaaggaacgcaaaccaagtcagacaagggctaaaaggcctagacttaggtaaccacaaagggcctaaggtgccctttgcctgagacatttcagggaagtaagtggcagtgacagaggccagagtacagagggttaaattgcaggaggtgaggaagtagagaccatggataaggctactcgcaggaagcctggctaagaacagggagtgagctaacaggaaatactggatcaaattgtattttccagcctgaacctcttctttaagctccagactttcatctcctcttgaattcctccttttcccccaccgactacactcaatttatattctggcctccccactacccattctccatacaacagtctgggtggtctttttaaactataaatcaggccatcataccaccccatactcaaaatatacaatggcttctcactgaccttagaatagaatcttaatgccttgctatgccctgtaagttcttgagtgatatgggacctgctttgcgctccagtatcttctcatacacctctcctcctcttagtcttgtaccaacctggtctcctttcagtccttgaattcattaagaacagtcctgccttaggatttttgcccttcctcctttaccaggaactagtcctaggcccccaagcccttcccaagctctgtccatcgaggcaggagcctcttcattccctcctgtgtttgcacaggtcctgcctcacccttctcagagctccctccaccattttgtgcaaataaacacccacacaccccaaaatcacctcccatccagcagatgcaggcaaagggtgagttacctataaaggaacaggccaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagactgcgccactgcactccagcctgggcgacggagcgagactccatctcaaaaaaaaaaaaaaaaaaaaaaaaaaaaaggaacaggccaccgcaagtgctcttccaaccccgtgcccaacggtttacctcaaatcaacttcttcagagcccaggttttccagccctcccagtgggatgtttcctgggtctcactagtaggggctttgatgtcaaaagacccaggccctagctcatttctctgctgccaattagttgtgtgccctttatcaaggcaccactgcatcaattttcttatcctaaaaaagataaacagtgtctccctagcctttaagaagctcaccacaaaggtgtactaacaccccagttctcagctccctcttccctgacccagggacctctctcccacctttgcatcacttgccttctttaccaggaacaagtcctaggccccttggcccttcccgaactctgcccatagaggcaggagcttctccattccctcctggggttgcgcaggtcctgcacctcactcttctcagagccacctcaaccattttctgcaaataaacacccacacacacccaattcaccacctatccagtagacagatgcctattctcaaccatctctcttttagccttggtcactagctcctatcctaggcctggtatacaaaagcctcccaatcatgccctctcactctcttctccaacactgctggcaggccactgacacccagggcaacctggaaaccatggtttgaagatggcagagcatcattagtctgggccccctccatccccacaggtgactggattttaaatgagcacagaaatgtctactgttttaagccactgaagtttctgcagggtttatctattacagtagctagtgtttctctacacaatacaggctgaattaaaatggcagctggagagaagggagaggactctagtggtaatgaagaaagcctggagctaggattaggcatagcctgacgaccatctccatttctgtattacttatcctcttcaagtactttaaaatatgttttctcatttgacacactttcatcaatactattgttattaacaattcacaaatgaaaaaaatggacttagtgaagttaaggtatgtccaagatcccatagctgataagtggcgaagccaaactggacacaggacccctgactcttagtctaacagcatcttccctgcagcatctaatctctcaaagccacattctagtgccacatcagacacactgaactaaggtacaagggtgctagaatgaaacaaaaaggataggtagtctagtagaactgataaaaggcagattgtggaggtcttcgtaaatatcagactgtggagtataacttttattcaaaacacaatgagaagcaaaaatcaactcccacttccaagctccacacagtaattttatattttacctgccttcaaagaccttactgcatcatctacccttggctatcagtggataccaatgctccactttacacaaaaaaatagaagcttttacaagggcaaaaattccagccccttgccttctatagacttctctgtatccccaaatagcctttcctctttccacacagtcaaatgaaacaggcactcctcctctggcaatgctactggccatctcctgtgcatgcccctccatccacagaagagaccctgttcaagcacttatcctttctcttcctgaatctctgatttttttcctttctcctggctcctcctttcctcggcctctgaacatgctagagcccctctcatcctaaaatcaccccttccttgggaagcccatagccccctcttatcctcacacttcctagctgagctcttttaagcatcagcagtgaaaatgcatctctacttcattaccatggattctctactccacccccacccaaggtaatgtggtggtgggatgctgaaacattcacctccagtgatacctcttaagagctaaatccaatggacaacttccaacatttctcttactttaccttttcatggcacttaacactgctgtactcccaccttcttgaaattatcccctgccttagtttccatggccccattctctcttgatcttccccctgtctgtctactcctacttggtttccagtatagtctcctcccctctgcctcctcactaaatgttggtatttcctggggttccatctttatacttcctcttactctacatactatactttctgtttgaaatcatccacagatataacttcaactgacagctacacactggagacttccacagtgtgtagctgtggaagtgtagctatatctccacagtccagaccactcatgtgagctctccacaatctggctacacgtgcctgccagtatttccacctggattccatgggtggaattccagctcaaactcaacatggctaaaaccacagcaagcatcttgtttaccatgcttattcctcttcttactgcatccataaggagagcatttattattgtctcagtaagggctctacagagaaatagaaccaatatgaaacaactatatatatgtgtgtgtgaatggatatctgtatgaatacacagtcatactcacacactaagatttattttaagaactggctcacgcaattgtagggctgacaagtcttaaattttgggcagaccagcaggctagaaatggaggcaagaattgctgttgcagttttgaactcccctactcgaacaagtacccaggagacaggtactctcctctatatccccagcatcttacacagacttgacacacagcagaagctcagaaagtgttggctaatggccaagtgggtataaagtgagatgttattaaatgagaatgggacaataggatgaatcatcatggggaagaatcaagacttgaccaaggactatgttacaaatcaagacatagcccttctggggcattcatttgccagaattaccgcatcactacacccatgactgaacaaggaccattacacagatagaagcatatccattcaatactatatttgaatgtctcaacaaccctgttaagttggcatggcaaagaaaaggtcacattttatgagtaaaattgaggttcaaagattaagggtcttgtctaggttgctacaaaaaatacctacaacgaaatgtcttagttgttcagtgatacgcaaggtaagagggaacattaaaacaacagaaagttggctgggagcggtggttcatgcctgtaatcccagcactttgggaagccaatgcgggtggattgcttgatcccaggtgaaaccctgcctctacaaaaaatacaaaaattagccaggcatgttggtgcacacctgtggtcccagctactcgggaggctgaggagggaggctacttgatcccaggaggtagaagctgcagtaagctaggatcacaccactgcactccagtctgggcaacagagcaaggccctgtctcaaaaaccaaccagctgggtacggtggctcacgcctgtaatctcagcactttgggaggccgggacgggcggatcacgaggccaggagatcaagaccatcctggctaacatggtgaaaccccgtctctactaaaaatacaaaaaattagccaggcgtggtggcgggcgcctgtagtcccagctactcaggaggctgaggcaggagaatagtgtgaacccgggaggcggagcttgcagtgagccgagatcgcgccactgcactccagtctgggtgacagagcgagactctgtctcaaaaaaaatataaataaataaataaataaataaaccccaaccaacgaccaaaaagtaacagctcagctcaaaactccttatcaacataaacctgcaaaaagtaatcttctactatttacaaagaatactttttattataactattgttctgatttttgtactatattgtggtatgtattgtattattagaattatatatccattgttgtaataaaaaatttctggttatatagtaaatatccagaagcactgttttctgaaataaagccaatatgtattaaatctacgactttaaagataactatatagccctaggtaccacctaagtagctggtttccttatttattaatatacattagaattagtgaaatgttaatattcagttcaagcattgtatttggggatgcgacgcattctctgaagccacagagaagtgaaaatactccattagtcattcttgttaaagaagacacggctgattactcccaactatatttgcatatatagtaacttgacctttgcaaagctcttttctacgtggtctcatccagtcttagaaaaatcttataagccagggcaaatcctttttattttacttgacagaaaatagggtcaaatgcttaaggtcatgtaattgataaaaggcaaaagtgggactagacaccaggcctttcttccccaaagcctacagtcattctataaagctctcatggctttctggccataggtccactagactgtgagtaccacagaagaccatgtctgatttgctctccattggtgtccagcatagtatctgacacatagtagtcacataataagtatgttatttggtgaattactgaaatcattttcttaagtggctttagttacctgtatggtaaaatggggcctatagcattgccaaatatcttggctttttaaatggtattgtcattatcaggaataaacaaaaaggaaatgctatcttctgtgaactatatatgttgattcccaaggggatcaaaattctgggccagggccccatttcagcacaaaaggtagcaagtagtatgtttttcagcttcctggaaaattaagagttgaatggaggggtcaagtggaagagccttaacatgggaaaggaaaaattgaatgcaagatttcaggcataacgatgaccacctacaaggctagcacaatggtccagctatagctaacctaccatggcaagaaatgggcttgccaaaggagtgtgaactcatccagagagtacacacaccagtgagagagaatccactccatggcaggaagacatagctttgaggtaggccaagcccaggaaccaagtgtgcaaaggtctagggcagaaagagccactctggacatggcttcacaggctttctgtaaaaccatctgtgcttagccacctagagcaaggcagaatgaggagcagctgacctcctttggtttactgtggccaaccccacagggatctaccgaccacattgacaaccaccccagagaaagatacccagaaatgagatggtgagtattcaaaagtcctgttaacctggcagactattcatttcctatgaaggcctcattaacatcatttagagctctattttccctccattttaaaccatatattcaaacatatacatcccattatcattctggttttctattcactaccataccactatatatcccattctttcagatctctactatgatcccaagatcattttcagctatgcttccataaaagcccttctccaccaaatattccttaatgcatcacacattaattacagaaacaaggtatccaaagcaattgagtcatttcagataactgaaggctaattcattaagcaccatgttgtagtcttgctaaaataaatgatgccttagtaaacataaaatatcaaatgtaatttactagttccaaaattttactcaaacttcaagatccagtctgaatacaaacattcccttaaagcaacctccaatctcctcttgccacctccatccaccactagaaataacctctctttcatctgtgatcctataacattttgattatatctccttcacagcacatagcatggtctgcttgaggttagagatctaaatgcacctcgactttttaaaaagttccttgaggacatggaccctcttttcaactaaggtacctagttcacagcaggaatacaaacacttcacaagatgaatacctttagtgacttaaacattataaagagcaccgtaatacagcagagcctgcaagggttcctgagctctgacgggaggaaaagtgtgacattaaagaacatattatcaccatcacactgatcggttgagtattcctcagctttagaagaaaatgtttttctaaaagggaacaacactctgaattcctttttttctctaaaatggaatcactttttacaaatctcaacttgcaaaatgaaagttctggttgaaatggcattgctaatcctccacggccacattttctaggcctcatgatgtacatttgactagctccctgtagttcactgaggagaggagacagtgactggaaggatgtggtaggtgactggaatgcaactgaggtgctgctattcaccagtttgaaagccagccttctcagtccaagaggaaataagaaatggaacacatgattgagcaaatcaagttttaggctcaaggtccatagcaaccacttcaacagtgctgacaacattcttttcccaaagctttagtgtttgggtatgataaaccaggtggtatagtgttaagtaatctaaacaatgcaactcaaattcagaacctctttaatagcaacagggggagtgtaagtggtcagccaagaatgactaactccaagttccctcgtgagcagctattcttttgcaggattcctctccttgtcatggaaagaattttcccagggaaaatagggagaatggggcagtaaggctaccagtatcataatattaaatatctaatcatatagacaaccccttggggataacaactgttcttaactttggcttgttgagtaaaactttgtttttaaatccagtatcttcagagacagaattgtgcacataattttacaaatacctaaagcactaagcatgctggtttatgacggaaagctttctaaattgcacaacttccttctcagcctttctgaacaaactaaaccctaattcgacctattcctgttgaacatgataacaattataatcagttgatgtattcagagaccaccgaggcaaacaggttatgtttttctctataataaatgtctccaaacagctatactttgaattattttatagagcatttctgtttctgtcattactagctgtcccttcctgctgttgtcagtgtgtttgcctctgatagagcattcttagttcactgtttctgatatcagatgtatcaggaaagccaaactcttaagtgtcatgggctaaggttccctcccaccagtcccaccttcttcagacccaggcaataggcttccagatgccatgttcttaatcactacagctgcatttcccaaacttgcctaattataaagaattaccaagtggggagggtgttaaaaatacacattctcagtctcctcctactaaagactgtagttcagtgggcccgggatagagcctggaatctgtttttttaacatacatcctcatatgattttcatgaacacgtttagaaacacaatactacatgcctctagtgctgccctcttgaattgggattccttcagaagtataatgaacctgggccatggccgactccttcctgagagacctggcaaccaataaaccttccaggtcactacttttccatctccctcgggtaaaatcccctgatcctttcagattcctgcagggtaaccacaacatctcattgctgggatctccaaccccaccccatttgctgaagattcggcccactttccttttctccatcctaaatatcctacaatccttctgatggcttctctgaccacacagatggctgaaacaactctccagcctctcagttacttgacctccttgaattcagccttcttcactgagttcacttcatttcagtcacttatatctgtagcaaaacacaggaatctgtcatgcccagtaattaattgctccaactctgaaatcttccactcatgcgtccctctctagccacatcctattactccatcactccacacacccattccttgacttcaacaacactggtccttttctcctccccatctagcctagatacctttagctatcacgttagtcaccccctggccaatatcccagttcctctgctccactgtctttctgccactcaccccagcaaaccccaaccctggctcaatccaactatatgccttctttgctcctaaaaccaggcagctgaatgctaccagtgccccagttaatccatggtcctatctcagtggagccctgcatactgcctggagatcatggacattgtctcaggttcattacccactcttcttgacctcaatggtatgtcaaaccttgttttcctctgacctcttcccatttattcttagcagacctcacctctatttcacagagatgataaccaccaccagacttggcacttgctcataaggcatcccaccagaaaatataactgtgcccagatattccaacatgcgagctgtcaagcccattatgcttaaactgagtctactgttcacttggttatttgaaataaactccctggtggtaagcattactgacgtaaacagtatgctggtgaatatctttctagtgcaaaaaaataaaataaaatagtatagccagcttcttgaaagatctctctaccctgagaatacttctaaagatggggaagaggtttttttttttttaaagaaagctatcttacttcacaagcatttaacaagcacaaatccaaacatacgttgtcatacatcaatagaataattataaatcccaacccagatagttaattctgattttttttttttttttttttttttttgagacagagtcttgctctgtcaccaggctggagtgcagtggcgtgatctcggctcactgcaacctccccctcccaggttcaagcaattctcctgcctcagcctcctgagtagctgggactacaggcacgtgccaccacaccaagctaattttttgtatttttagtagagacagggtttcaccatgttggccaggatggtctttatttcttaacctcgtgatccgcccgcctaggcctcccaaagtgctgggattacaggcgtgagccaccgtgcccggccaattctctgataatttttataaattcaaaactacggtcagtgaaagaacactaagttagttattgtctgtcattcactcttatccaaactctaaattgttgatgagtttacaagtcttttcttgaggatttttttttctccttataatagtaatagctaacattgatagttttttgtgtataattctgctcctcaaaagatcctatgagataagaactattatttttctccatttacagctgaaaaaacagacttagacatgtaattttcctcaaggcttacagctagaaagtggcaaaggtaaaattagaacacagagcctgaaagcaaactatctatatgctttggcatagtggttattaacagaagcttcccaggagaatataacatcctaacccaagtgttcttatttttaatgctctcatacatgcttagaaaaacaagagaaaccatcagggattaatattgcagcatatttcatattcattcattcctgcattcatatcagaaggcagtaatgaataagggggaaggttctaaagtcacatcacatagattaaaatcctaattccaccatattcttagctatgtaactttaaacattacttaaattctctaagttcaattttctcaactaaaaaaacagaagtggtaatataattaccatcatcaccatactgggttctcccgaagatttagagataatgtgtgaacacacatagcaatggacctggtacatacgaattctcgaaaaaagtagctattaaaataactattcaaaatgttctgaggccctacacctactggactctgggcagagcactgggtgctaggactgtaccatatacaggacaaggctgtccctgccctcctagatcttgtagtctctattgggggagtagacaataaagaagaaaacaaaagaaggaaacatataaatgaagtgctattgagggggtaaagccagctggacttcctgggtcgagtggggacttggagaacttctttgtcttacaggaggattgtaatatgcaccaatcagcactctgtagccaggattgtaaaacgcaccaatcggcaccctgtagctagctagaggtttgtaaaacgcaccaatcagcactctgtagctagctagaggtttgtaaaatggaccaatcagcaccctgtaaaatggaccaatcagcaggacatggacagggacaaataagggaataaaagctagccaccccagccagtagcagcaacccactcgtgttcccttccaggttgtggaagctttgttttttcgctcttcacaataaatcttgctgctactcactctttaggtccatgccatctttaagagctgtaacactcaccacaaaggtccgcagctcctttcttgaagtcagcaagaccacagacctaccagaaggaatgaactccggacacactatgaattttagtgaagtgcaagcaataaatgcacatgtgctgagatagaggacaatggggaggaagctactatagaagtggtgatcagggaaggcccctctgaggaggagatgttttagctgagactggacgtttaaggatctttctatgagacaagtggaggtcttgaagagcctgtacagaagaggagaatacggcatgtttgaggaactgaaggtgttcaatctgacaagcatggcaaacaaggaggggagcctggagagggagcacgtcagagtaagtgtggatgcgagtccaagtgcagtggaagccaccaagcaggggggtggcatgcttgggtttactctttagtaggatcactctggctgctgtgaggaaaatgtgctagaagaaagcaacagtggaagctgggagaccaaccaggagacagggaatcatccatctgagagaggtgggtaggtgaattaggaagatggaaaaaagggagggtttgagatattctagaggctaggccaaaaagccatacagatgggttgcatgtggagtgaggaaatgagaagaatcacagacaactttcaggtgtccagcctgaacaatgaatagacagtactaactaacagtgagacggaaggctgaaggggagagtaaggaagggtcaggaatgaggaatacaaatttcgaagcttgagagggagattgagagatcagttctgaacctgtgaaatttgagatcactgggacaggaaggtggtagctaaaactgcaagtctggaaccagagaaagggtggggagacgtaacagaaagagtcatctgcatccagggggttctagggtcctgggaattgatgagatcatttagagagagaatatgatgagagaagggaggtagcagagccagaaaagaaaagaaataatcaaaaatcacgttgataatttaaaactgaacatggtaacacagcccacacaaacatagaactggctcaaatacatgctcaatcaatacctgtggaacaagtaaaaataaattcttaacacatacttttaggccttttttttttttttttttttttgagatggagtctcactctgtcgcccaggctggagtgcagtggcgagatctcagctcactgcaggctccgcctcctgggttcacgccattctcctgcctcagcctcccaagtagctggaactacaggcgcccgccaacacacctggctaatttttgtatttttagtagagacggggtttcaccgtgttagccaggatggtctcgatctcctgacctcgtgatctgcccgccttggcctcccaaagtgctgggattacaggcatgagccaccacgcccagcctccttttaggcctttaagaaaataattttcatttaggattccccccttaccaccaccactaccaacttcttgtatatttggaggataagaaaaacaagtttttgaaggtctctgtttggattgtgttcaaggagatcctttttcttaaaaataagaagcaactgtttttttccaaaaagtcactaaaatgaaaagtagtctacctgaaattcaaacctttgaaaagcttacgctcacattacgacttctctgtaaaaattctaccccaagatacaattttcccatcctcataaattaaaatgcaattatacattttactacagatgtttcatcctgaaagatgaaactggtactttcaaacagttcaagagtcacaggagagatgtaaaattgcaaaaggtcaaggatttattttaaaatgttaaaaaaaaattaagtatacctgctaggccatccaaaaactgataagcagggagaggaaaaggacagaattgccagaaaaataagtaaatatgtaacagctattccccaaatgaaaacacattaaagctataattatatctctgggtatctgttgacacaaaaaccccactatgctcttgaggcttacactatcactatcaactaccaaattgaaatcacagctgtaaacataactgggaaactttatacttttcaaaaatatccagtgtgacacagggataacgcataagaaggaaagccaacaacatttgccaaaaatgttccttccctcaattgttcaagttaaatcaagaccgtaattctttttaagaccacagcctcactttgtaaaattcttctcagatatagatgagaaagaaatatcctgacctttaagagattgtcattttaactcatgacacagctacctagaagcctagaaggctaccagcaaggtcatatgaatagatggataatgagcattcattctttccttcattcattcaacaaatattaagtacccacaatgggccaggtgcagtttctgagccctgaggatatatcggtgaaaaaaaagtctcacacttcagggttaatgagggagagagacaatacaccaacaaataaatatgtattaccaagtggtggtaagcaaggcaggataagaacaacagggaaatggggtgtatttgataatgcagtcaagcaaagccagacaacctaacttttgagcagagacctgaagtaagggagtcaactatgttaatatccagggaccagagttctaggcggagggaacagcaaatgcaaaggcactgaggctggagtatgcttgacttttttgagacagagtctcgctctgtctcccaggctggagtgcggtggtgtgatcttggctcaatgcaacctccgcatcccgggttcaagcaattctcctgcctcagcctcctgagtagctgggattacaggcacgcaccaccaggcctggcttttttttttttttttttttttttttttagtagagacggggtgtcaccatgctggccgggctggtctcgaactcctgacctcgtgatccgcccgcctcggcctcccaaagtgctgtgattacaagtgtaagcttgatgtttttaagaaacagcaaagagatctgtctggcaaggctcgaagtgaggatggttgttcggaagagggttagcctggcaggccacagcaaggccttcagagtttactttaagacaaaaagctattggagggctctaagcagaggactaacatgatctgaattttttaaaggattgcaaagagaaacacaagttcctactcataaaacaaagatgtatctctcataatctagttataagtcaaagaaaaaaagcatagaataaaagttgtgtagtatgatagcatttttgtaagaaaaaacacgtatacatgggaacaaggctaaaaggcttaataccaaattgtgatttactatggtttgtgggattatggggttttttttgttttgttttgtttgcaatgcttttctttgtttttcaagttttctgccttaaacatgaattactttggtaatttttaatgttatctttaaaaagaaaaaagcactccaccatgagacttcccttgtctgaaatcttacttcaatatgaaaaaaaaaaaaacaaactcaaaaccaaaaaccaaaacaacatggggaacatttttttccaaaaattaccacacttcccatgcaatgtttgcctgtcatgaaccactgcacaaatcaagccccgctcaatgtatcaaggtcacaaaaccaacttggttaatatgttgatcattacatagtggctctgtcctctacagcaactttgataccatctttccaaggcagcaacagaagggcccttttcattcattttctatgtgtctttgatactattttgcgcttctggatttttccactgtatgtctcttagaaacaaattaagctcgaataagttgttccagctaatgaagtgcgcttttggctccttctccgtggttcagaattatccggcaaaataccaattgttttaggatgcattttctcttagttttgaaatattgcaatactaagttaccacaaataaagagcattgagataacaacacacaagaacgtgtataaatggaaactactgtaatccttttttaaattaaggacgtgtggacgcctcatgaataaacatttaggatatctggataaatatatactatgtgttcacatagataaaaacagaaaggagcattccttcctacctcactcccccaccccaagtcacataagtttctcgcagggcacaagcccagggcaatcactgctcagaaatgtaaaccatgcaactcaaaatgactcaagccctcaaacactccccacctaagtcctacatcccatccactcctcaatcacttccaacaggcttccctgaatgaaaatcccaaactgggaaggcttaacaagctccaaactccactcacacgccactcagggaatccgaggacctggggcccacgtgtagtgttttcgcgtgggcagacaagggtcccaagattcagggtgctactgtaccccgagtggttcgagtcctggctctgccgccttcactggtcgagctgacgctctttacaccgggggcatgggctgccacatcccagcagagtgcaagggccctcgggcgtggacgcaggcggctctcgggtgcacacgcggaacgcacactcgggcatgcactctcacacggtcaggcgggcctgcgcgaacgcccccgcttcccctctaccacccccttttgcgccttctacgatggtggcacgcggggctaccctgacccctaggacccctggacgcccgctcctggagcccggggggtgatgacagatggcggagggcggggctccggggggaaggggcggagcctctcagcatgggggtgctggcggctgacagaaagaccaggggcagccggcgggagggggctgactgagactgcgggccggccgcgggccaggcgtggcgggaaggagctcgcgcagacacagggtctgacaggcagagagagatacagacaccggggactgacagccgcgggggcacgcggggccggctggccgtggcgggcgctcacctggcagcggcggcggtggcggcgcccgcgaccgggccgctcttcccgcgctgcgggcctccctccccgcggccgggcgggcggccggcgcaggccccgcagaggcggcggcggcggcgacgccggagccgcggactgctgagcggcggggacgcagctgcaccaaccgactccgggccgctcggctgggctcggccgctctcggaggcgctcggctctgctcggccttgcacggctcccctcggccttgctcgactcggctgggggcgtggcccaggccccccagtccgcccaggtcgcctctggcggccgcggggcggggctttcgagcgggtgcgagccccctgacgtcgcggggagcggaccttgcccccggcgcatgcgccagcactcctcctcccccctcctccccgccccaccgtgtggaggctgaagaagacggggaaggaggcgctgggggcggatgctgcggtcccagaggttcctggcttttgtactccatatcctgctctttccagaggaccacttaaagaaggtcacaccaggttacactttcaaaaggatgtgtgtgtaggctggcaggggctctcgctcctgtctgcccccactcctccaattccagtgtttcccaacaagcgtcgactaggagtggtcttttatccaaccaagggttcactgcaatttttaatattttctgttttcttaagaataataacaaaaaaactaactcttgatcactgttttaacattgagtcttcaagtacttgaactttcaaacatcagtcagcctcctcgagtccactaataccgtcctttcttcatagctgttgtataacctgtaatgcctgggatggggttgggttctttcctgaattctcgtcacatgatccaggcacctttttagttatggaaccaagtctgcagcaaatatgctcagaaagtggctcccacctttagaatccagtgattagtaaacagcaggagctctacggtcttgacacacctggatgggaatcccagatctgcattaatctagcaggttaataattgtctgagtgactttggacgtgttaatctctcaactgtaaaagggcaatgaaacatgagtaaatcagtagaaatattaaaagggttaaatgacaccacatataaagatttctgcacagtgcttggtgttcaataagtaaggctgcctttaacttcaagtaactttagaaccttcagatcctgaaaaccagggagcatatacacaagtgtgagcgatgtgtccaagtaaacaagtcgatagtcaaacacccatacgtggcaccttagcttgctcctttcacaaccttccctacctcagttcatgtcaactccattcttctgatgactccagacaaaccattggagtcatcctggactccactctccctatcatatcccacatgcaacccattagaaaagcctgtcagctctacctttaaaataccccttttcctctttcctggaatattgtagtagcctcctgcctgttctccacgattccactgtgctctcatggtgccttctctcaacacagaagccagagggatcctgttgaaacctaagctcaaaagcccccagaaggtttcccatctcagagtaaaagccaaaaaaaaaaaaatatgggggcagtggggtggagagtgggacacagtctcactctgtctcccaggttagagtgcagtggccccatcacagctcactgcagcctcaacctcccaaactcaagcaatcctcccacctcagcctcccaggtagctaggactacaggtgcacgccaccatgcccacctatttttttcatttccaaaatgtggtttttttcccaaaggcttccaagatcctatgtgtctgcccttcgtccacttatactctccacctctctaactgcacctccttccactcggcctcctcattgcatgccaggcacactagcctccttcttgctcctggaatatggaggctcacttctacttcagaacctctgtacttggtgttgcttcctccagatatcagaaaggcgtgtgctttccaagtttctactcaaaagtcacctccccagactttcccagaccactctactaaagtatcaagtcccaactccaatcactatcctctaagcctgctttacttttctgcctagcccttctaacctgaatatcatctataatatctctgaaggtgggaactttgtttttcccatcttcaacatctagaacatgggtcgacatgttcaggtactcaataagtatttctgggatgaatgagaatgtatataggttatactgctccaatacaacttcatttattcaacaaacttttctgagcatctattttgatccaggcacagtgggatcctgagaaaaatgaggtattctcccgacctttgaggaacagtatttcagaggaaacagtcatgtaaaaaaaatacttctggccgggcacagtggctcacgcctgtaatcccagcactttgggaggcttaggtggatgaatcatctgaggtcaggagttcgagaccagcctgaccaacatggtgaaaccccatctctactcaaaatacaaaaattagccaggcatagtgaggcgcacctgtaatcccagctacttgggaggctgaggcaggagaatcacttgaacccgggaagcacaggttgcagtgagcgagtttgcagcattacactccagcctgggcaacaagagcgaaactctgtctcaaaaacaaacaaacaaaaaacttctgggagaaaatatgtaacaaagatggatgtgccaactgctttgggaagcacagagaatagcataattaacaatatacaggagagtgtgggtaggcttcccagaaaaggtgactttggggccacatctaaagagttgttgagacagagattccaggcagaagaaacagccatttaataccagtgttggggggtatgtcacaaatgatatttacacacagaggcatattactttcctttaaaaaaaattaagcagatttcaggtaatccctataataatgtcatttgcactcacattctaatgagctttctcaagcagtaaggaaactgctagtatagttaatgcaatagttaccacctgacctctgttttattggaatgggctacacctgtgaactttttgtgccagggtccagaggcaaagaactatctgaagtttgctggctgcaaggaccagaaacccatcagaccaattcaaggaaaataaaaggggactttatctttaggctttgggtgggatggatctcacagaggccaagggaaataattagctgggattttggatgggctggaagcagagtaaggggagccagtatgactccagcaaacttgttttctctgcctccaggtattaataatacaatgggaaatgtgtctaccaacctctcccaagtatgagatacaattccaactacccagagactaaaactccctaatcattctaatcacaaaatcatgtagaaaaggctctaactgacccaacttgtggtaggtactctcctccagaacagtcatgccagcttacaggcatgaagttcaccaggaagccacctctgtgaatcaagaaatggccaattaccaggaaaagggaaattgtttctagctgaggcggtatcttgaaagaagtccctcacagaactgctggttccacatagtggcaaaacccctgggaaacatttggtagtgacacaggaaacaattgttgagttcttgatttctgcatagtagggaggccttttttaagtggcaataaaaaaaaaagttgttttttttttgttgttttgttttgagactgtgtcttgctctgtcacccaggctggagtgcaatgacatggtcttggctcactgcaacctctgcctcccaggttcaagtgattctcctgcctcaacatctcaagtagctgggattacaggcgtgcaccaccacgcctggctaacttttgtatttttagtagagatggggttttgccatgttggccaggctggtctcgaactcctgacctcaggcaatccaccagccttggcctcccaaagtgctgggattacaggcatgagccaccatgcctggcctgaaagctgtttttttcccagcaaaaaaggggacaaaaactgggatgctctccataagacctctgtaggcacatgataggattgtacttccttacaatagcttggatttgtgaatagccatgtgactttctttggtcaataaaatgtgagtagaagtacagtcacacattgcttaatgacagggatatgttctgagaaatgtgtgattaggttattgcttcattgtgcaaacatcatgcagtgtacttacacaacttagacggtaaagcctaccatactgaggctatatggtataacctattgctcctcggttacaaacctgtacagcatgttacagtactgaatattgtaggcagttataacacggtggtatacatctgtgtatctaaacatatctaaacatagaaaaggtacagtaaaagtagggtataaaatattttaaaatggtacacttgtacagggcacttatgaatggagcttgcaggactggaagttgctctgggtgagtcagtgagggagttgtgagggaatgtgcagacctagtaaattactgtatgccactgtagactgtatacacactatacacttactgctaaattttttttcttgagacagagtctcgctctgttgctgaggctggagtgcaatggcgccatctcggctcactgcaacctctgcctcctgggtttaagcaattctcgtgcctcagtctccctaggagctgggatcacaggtgtgcaccaccatgccaagctaattttttatatttttagtagagacagcgtctcaatatgttgcccagactggtctcagactcctggcctcaagtgatctgcctgcctcggtcttccatagtgctggaattacaggagtgaaccactatgcccggccatacttacactaaatttagtttttaaatgcttttatttggctaggcacagtggctcatacctgtaatcccaacacttcggaaggccgtggtgggaggattgcttgagggcaggagtttgagacaaactgggcaatacagtgagaccccccatctctacaaaaaaatgtaaaaattagctgggtgtagtggcacatgcccatagtctcagctactcaggaggctaaggttggagaatcacttgagcccaggagtttgaggctgcagtgacctacgatcatggcactgcacactagcctgggtgacagatggagagcccatctcttaaaaaaaaaaaaaggaaaggaaaataaataggtaaaaaaagattttctttaataattatctttagcttactttaacttttttagcttattgtacttttaaatatttttaactttttgactgttttgtaataacacttagctttttttttttcttgagaccatctcgctatgtcacctgggctggagtgcagtggtacaatctcagctcactgcagcctcaacctcccaggctcaagcaatcctcccatctcagctccccaagtagttgggaaataacactgaacttaaaacacaaacccactgtacagctgtacattttctttcttcatatttttgttctgtaagctttttttctttttcctttttttctttttttgaaacagggtctcattccaacgcccaggctggagtgcagtggagtgatctcagctcactgtaacgtccacctcccgggttcaaacaattctcctgcctcagcctcccgagtagctggaattacaggtgtgtgccaccatgcctggctaatttttgtatttttagtagagacagtgtttcacaatgttggccaggctggtctcaaacccctgacctcaagtgatccacccgccttgggttcccaactataagcttttttctattaacttttttttaactttttaagctttattgtaaaaagacgtattagccttggcctacacagggtcagcatcatcaatatcactgtcttctaccttcatatcttgtcccactggaagctcttcagaagcaataatatgcatggagctgtcaactcctatgatgaaaatgccttcttctggaatccctcctgaaagacctgcctgagactattttacagttattttttataagtagaaggagtacactctaaaataatgataaatagtaaacacatgaaccagtaacatagtcatttattacaagtatcaagttatttgtattacctgtatcatgtactgtacataattgtatgtgctgtacttttagacaactggcaacacaggtttctttacatgagaagcaccacaaacctgtgactaacgtgttgcactctgatgttatgatggctataaggccactaggtgacaggagtttttagtctccattaccatcttatgggaccaccactgtacatgcagttcatcactgactgcacgtacagtgttgcaccattgtatatgcaaaacatcattgtgtggtgtataattcaccatacatcactcccaggtccaaagctaagtcttgagatatttgtacccccatgtttatagcagcattattcacaataatcaaaaggtagaaacaactcaagcatctattaacagataaatgggaaaaatatggtatatacatatgaaagattatttaatctttaaaaggaattaaattctgacatgctacaacatagatgaaacttgaggacatttttctaactggttaagtaaaccagttagaaaaaggcaaatattgtatgactccacttatgtaaaatacctactatagtcaaattcatagagacagaaagtaaagtggtggttgccaggggctggggggaagggagaattggaagttattgttttatgagtatagagttttggttttccaagatgaaaagagttctggagattggttgcacaacaatgtgaatgaagttaacactagtgaactgttcacttaaaaatggttaatacagggccgggcacggtggctcacacctgtaatcccagtattttgggaggccagggtgggtggatcacttgaactcaggagttcaagaccagcctggccaacatggtgaaaccccatctctacaagaaatacaaaaattagtcaggtgtgatggtgctcacctgcaatcccagcgacttgggaggctgaggcatgagaattgcttgaacctgggaggcagaggttgcagtgagctgagattgcaccactgcactccagcctgggcaacagagagagactccatctcaaaaaaaaaaaaaaaaagttaatacctagatttatgtagatttatgtagattttaccgcagtttaaaaaaaataaataaatcaaatgggccgggcggctcatgcctgtaatcccagcactttgggaggccaaggtgggcagatcacggggtcaggatatcaagaccatcctggccaaaatggtgaaaccccatctctactaaaatacaaaaacttagctgggcgtggtggcatgcacctgtagtcccagctacttgggaggctgaggcaggggaattgcttcaacccaggaggcggaggttgcagtgagctgagatcacaccactgcactccagcctggtgacagaaccagactccgtctcagaaagaaagaaaaaaaatcaaatggagataataaaatggaataaaaaatacttggctactccaaaagaaggacaaaaaaattaaacagggacaaaagccaggtaggacaaatagatttttttaaatagccagattatatacttaaatggtttgaaatcatatctgtaattatattaaatgggaatggactaaatattctagcaaaaggggaaaattaacaaactgaaattaaaacaaacaaacaagactcaactatttgacgctggccaggtctggtagctcactcctgtaatcccagcactttgggaggctaaggcaggtggattgcttatgacctaaatacacaaaataaaactataatcatggcctgacatacagaagatactcaataaatatatcttgaatgaatgggtgcatatatgtgatatgttgctccaactaaacttcacttattcaatgaacagccaaaccaatttttttggatatggacttaaacatgaaaggtaaaacaataaattttagatgataacatacaataatatcttcataacctcaaggtagaaaaagttttcttggccgggcgcagtggctcaagcctgtaatcccagcacttgggaggccgaggcagacggatcatgaggtcaggagattgagaccatcctggctaacatggtgaaaccccatctctactaaaaatactaaaaaaattgccgagcatggtagcgggcgcctgtagtcccagctacttgggaggctgaggcaggaaaatggcgtgaacccaggaggccgagcttgcagtgagccgaggtcgtgccactgcactccagcctgggcaagagcgagactccgcctcaaaaaaaaaaaaaaaaaaagaaaaaaagttttcttaaacagaacagaaaaagcactagccataggaaagatcgataaattgcactttttttttttacaattaagaactgttcaacaagagacatcactaagagagtgaagaagcaagccacagatttgccatgcacataacaaaagttttatatccaaaatatacaaaaactactatatagaccaatagaaaaatgggcaaaaataggctcttcacacacacacacacacacacacacacacagacacaaatccaaacagccaataaacatgtagcaagtgcttagcctcattaatgatgaaaatgaaatacagcgaacaactactacagatccaggtggctaaacattccaagtctgacagtaacaactgttggtgaatgtataagggaagctcttatacattgctgaagggagtgcacttgtataaacattttggaaaacagtttggcattattatttttttttgagacacagtctcgctctgtcccaagcttgagcgcagtggcgcgatcttggctcactgcagcctctacccccagggttcaagaaattctcctgcctcagcctcccaagtagctgggactacaggtgtatgctgccatgccctgctaattttttgtatttttagtagagacggggtttcaccctgttggccaggatggtcttgatctcctgaccttgtgatccacccacctcagtctcccaaagtgctgggattacaggcgtgagcaaccgcacccagtagcattattttaagttaagcataggcatagctcataacccagaaattctgctccaaaatacatacccatgagaaacacatgcccagatacagcagtagacatgtacaagaatgttcacagcagcattatttataataaccccacgttggaaacaacccaaatgcccatcagtagcagatggaataaattgtgatatattcactcagcagaacactacagacaacactgaaaatgagtgaagtatagctgtgcacagtaccatggaagaatctgataacgagtgtgaagccagagaagtcacacacacatcttaagactgcctttctataaaacccatagccacacaaaaccaaacatgtccctcccccacaatcccccaccactcctctacttatgagacacagaaagagtggtaatagagacagatttcatggtaactagttagggaatcaccattttgtacccaggcacagaaaaccaaccccctactggaatatctcctgcatgcagggatgaggagagaaactggccttcgaggtgagggaattcaaggaagtgactgacagctctctgctgtggggatagagaacattattacggtcaggccacccttctgttagaatccattgtgatgacttcagtgttacttttttttttttttttttgagacaggggctcactgtcacccaggctggagtgcactgtcactatcatggctcactgcggcctcgacctcccgggttcaagtgatcctcctgagtagctgggactaacgcagcaccatgcccaactaatttttctatttttttttgtagagacagggtttcactatgtagcccaggctggtctcaaactcctggctcaagtgatccacctgcttcagcctcccaaagtggtatgattacaagtgtgagccaccatacccagctacagggttattttaataaagtcactgaaagttagggggtcataatgacccatttatagcatgctaaactttcatcaggcactggaggccacgatatgggacaacaagcaattcctgaggtgcactgcacattagcaaaagaaggccatgcagctctggaaagattctcaacaataaacataattaagtttgttgtatgttcctccagatttttttagggtatctaaacgttttttattataaatatggtattatattacatgtattgtttacctttttaaaacttaacagtagctgctaaacatctgttaaacatattttaatacatagagacctacttcataatttagggggtgatggaaacttcataattctgggtgtgattaatatacttattaccttgattgtggtgatcatttcacaggtacacacatcaaaactcagtgtacactttagatatgtgtttttttgttttgttttgttttttgagatggagtctcactctgtcgcccaggctggagtgcagtggcgccatctctgctcactgcaagcttcgcctcccgggttcacgccattctcctgcctcagcctcccgagtagctgggactacaggcgcccgccaccacgcccagctaattttttgtattttttagtagagacggggtttcaccatgttagccaggatggtctcgatctcctgacctcgtgatccgcccgcctcggcctccccaaagtgctgggattacaggcgtgagccactgcgcctggcctagatatgtgttttattatacatcaattatacctcagtaaaactgaaaaaaggttgtgttttaaatctctccccaccgtttttttttttttttttttttttttttttggcacgacagggtctcactcctctgcccagactggagcacagtagtgtgatcatagctcactgcagcttccaactcttgggctcaagcaatcctcttgcctcagcctccagagtagctaggactacaggcacgcaccaccatacccagataattaaacaaattttttttgtacagacagcctcttgctttgttgcccaggttgatctcaaaatcctggcttcaagcagccctccctccttgacctcctgaaatgttgggattacaggcatgagccaccacgcctggccttgtgttttaaatcttttactgttttcttccacttaacactataaattccatccatgctgttttatgtctatttcatgtagaattccaaggtatgtatccacaacattttactaactcatcccctagttcctttgcctctagttcctgtatgccattaacactgtaacaaataacctcctgcttgtcttcttgcggatctgagcaaactttcttcaaaatgtatttccaggcatgagactgctacactactgagccctatgcatacttaattttactcagaactactggcttattttatagaagggctgagcaagtttatattcccaccagtccaatctcttcacatgggtttctgacccttcgcgttgcagtaacactgagacgatggatgttcattcctggtgccccgattcaatttgaaattgacttcatggtcactgacaaattattcttcaggttgtggcagggctgaggccatttcctagtgacttaacagatggaatttgttctctattttcacttgctttttaaatgttttcggggaggggtgcctgttagagacaggagcactacagactgtcttccctaggcactccctggcagccttctaagtccctaactacatggagaaactgccttgggtcagtgttttaagctgcaaggaatgttgtgactcagctagtcgttcagggacacctcgatgaacaaggccacgggaaggaagtcattacacagagagctggactgtaaaaaccaaaaatactctacacaccaaactctagagcagtgcagcagtacatcccatgactcaacgggacagcttctgccacgtggcacacagctccggatatgtggtgcgcagccctcactcgcggctctgctgccgctctgagctgcttggaaagttgatggggtggggaaatctgtgactgtattctctctccaccccctccactctgaccattgctcctctcatcagctccccctcttcctactccttctttaaccctcttgccctgcaaaaacaaaaacagctggaatttagtatttcacacatgctggcaatttagtggggacacatggaggtcaaaacgctggcactctaggaagaccctactgatcaggcagacactgggcaacaggtcatatcacctgggacagggtcaagagtactgggcaaagaggcagccccaaggaacagagacttcaaggtacaggcaaaacctttaaagatgtggacattcactcactaatctttatcagagacctactatgtgccagatgctttttgtttgtttctttgagacggagtctcattcactggagtgcagtagcaccatctcggcacactgcaacctccacctccagttcaagcaattctcctgcctcagcctccccatgagctgggattagaggcatgcaccaccacacttggctaatttttatatttttggtacagacagggtttcaccatcttggcctggctggtcttgaactcctagcctcaagtgatccacccgtgttggcctcccaaactgttgggattacaggcgtgagccaccgtgcccggccccagactgttcttaggaactgtcagtgaagacagatcagatgtcttgtcctcacggggcctgcattcttttggagggagacacacacataccagacatcctcaagaagtgaattagcactcaaggaagttgttagggctactggaaaagattagagcacagagaggtgtctgggcatggtcagggtagacttcatggacattggtgtggtcttgaggttagtgagggagccagccaggtaggcatctagggaaagaaacttctgggcagaggaaacagccagtgtgctttttttttttttttttttttttaaagagagagtcttacgctgtcactcaggctggtgtgcagtggtgtaatcacagctctgcaaccttgaaatcctgggctcaagcgatcctcccatctcagcctcccaaagtgttgggattaaagacatgaaccactgcatctgaccaagtatacttttaagtgtactcaataattggtttccttttcctcatctataacaacagtttctaccttttgtccagctcctgagagccttgagttctaatcacaacagcccctcactcccagtggcagcccttccatgcagcctcccctctctagccccactctgcctgttagcatctgcagccatggtgcaggcctagtacatggatgagttcccagactgctggaggcagccccaccaccccgagcccctggccacccagtgggccagaaacagccatgctggctcagggtgcactactaaagctggacactgacaaatgagagaatgatccagaattagaaaagactcaaagagagagaagctactcctggatagacataataaccatatgtaaagataaattaccaaattatgaagaaaagattaaggtgttttatggggagcatttacacttggatgatcggatctgttacatcccgggtggcagtggatacttttgatatgacagataaagaagacaagtgaatctacatcttcatggagaaaggagacataactctccccacaggaattcgtcaccacctcactctggatgaaaagaagtacgtgaaggccatatggccattcagggagacccagtgtggacagcatacaatgggccagctgaccatttcaatgtccagggacaatacatgaaatttctggcacagacagcatagcagggctccctgagaacatgtactttgtgaaggtcctaaacgtaactgagcacaaaatcatttttctctttgcttttatacggtaaacttgtctttcctttgcaagattatttgatcagaatgttttttatcttatttttattttttgagacagagtctcactctgctgcccaggctggagtgcagtggcatgattccagctcgctgcaatctccacctcccaggctcaagtggttctcatgcctcagcctcctgagtagcttgtatacaggtgcacatcatcacacccggctaatagaaacagggtttcaacatgttggccaggctggtctcaaacacctggcctcaagtgatctgcctgactcagcctctcaaagttttgggattacaggcatgagccaccgtgcctggctcagaatattttttaatgaaaggagcaataaaactgatttttacatggaagcaactgtggaaatgaagacaagtcaccttcgttttgtctaatgcaatcaagactagtggttcagtagccctgtgttagtacatgcactcatctttagtccaaatgagagtttcatctcccaaaatgtatctccttagatgttctatctggacatgatattgtgcctgccttgtaacaaggtgcaatggtagataaccagatagaagacactttttttctcccaaaattatacactgaggtggggaattatacacatagagggaagagctcttatgttaggcgacacattctgagttgcttatgccactttcttgttcaaaataaagtcattgctgggcgcggtggctcacgcctgtagtcccagcactttgggaggtcgaggcgggcagatcacgaagtcaggagattgagaccatcctggctaacacggtgaaactccgtctctactaaaaatacaaaaaattagccgggcttggtggtgggcgcctgtagtcccagctactcgggaggctggggcaggagaatggagtgaacctgggaggtggagcttgcggtgagccgagattgctctactgcactctatctagcctgggctacagagcaagactccatctcaaacaaaacaaaacaaaacaaaataaagtgactgcctcaattttatgctcatggcttggcattatcttatattcaagtatatatggtattttgcctagcttgttaaaatcaccagtttagattctttgtgtgactgtatatgtatgtgattaatgtgtatattatctgtgttggtatttttttcagtgcgagttgtctaggttctttcacaatcaagattttaacagaattagtattttaaaatttatcaagagaattagtacgttatttttctactcaattctaagactctactcaattctaagacacaattatgcctagttcgttataatcatagaaaaaccccaaataaatttcatgttttagaaggtcaggttgttttctaagtatttttctaaaactggatgaaaatttttcatgttaaaattaatttttcattactttcacactggtcttgggggtctgtttctcactgcacagaggaaagtcgatccttaaatgttattatcatggtgcctgtgtacattttaatcctgaaattattaattttaggattaaggccaggtgcagtggctcacatctgtaatcccagcactttgggaggctggggcgggtggatcacatgaggccaggagtttgagaccagcctggccaacatggtgaaaccctgtctccactaaaaacacaaaaaattagccaggcatgtggcacacgcttgtaatcccagctactcaggaggctgaggcaggagaatcacttcaacccaggaggcaaaggtcacagtgagctgagatcgcaccactgcagtccagtctgggcaacagagtctctatctttaaaaaaataaataaaattgtaaaaaaggattaaaatgtagacaggaaccatgataacataaatatcatagggctttcttctgtcaaattttactctgataaagtgctgatctgatttttttttatggattcatttctaaatggtcattgtaaaatgcaacttccttcttcttggagacagggtcttactcagttgcccaagctggagtacagtggcatgatcacagaatcacagttcactgcagcctcaacctcctgctctcaagcaatcctcccacctcagtccgccaagtagctgagactacaggcacgtgctaccacactcagctaatttttttttattttttgtagagtcagggtctcactatgttgcccaggctggtctcaatctcctgggctcaagcaatcctcctgcctcagcctcccaaaatgctaggattacaggcgtgagccaccacacctggccaaagcagaatattataaaatgtaacataatcacaggagtgatattccattacctttgccatattctattggttaaaagcaagtcacaggtcctacccacacttcagtgaaagggatgacacaaaggcatgaacaccaggaggcagaaatgcaggggccaccttagagtctgtctgccactgaagacagtaacaatggatctggaatctgaaaaatgagttggcatcaacaatgtggacagagggagggaagaactgtccaagcagagaaggggcaggacggtgaaagcagatggtgtgtacaacttatacaaagggcctagtctagtgactagcaataccgtatcactctcctgctcaataatcattgatagctccccagtgcccatggttttgccccatattcaaggttatctccttgcattcgctttgtcttcaatacccatgccttcactcaccacttccacccacttagactgcctattgcctcctatatttaccccatctatatatagttcaaggcccagcataaactgatattctgtaaacaatatttctgaatatctaagtggagggcactgtgccagatcctcttggagttgcaaagcttaagacatggtccacatgccagatggagggcgggtgggggcagaaggtacaccccaagaagaaaaagaataggaggtccctttgttgaggatcaaacccatggggcagttgggaaatcctgaagggatttttaggccacagaaagctccacttcctacattggttaatgatctttcaggattcctctccaggctagaaattacaaacaaattccaaaaaggctgctaaactgacgtctttccgggagtcgggaaccgcacagttgcaatctagacaagccgggtcactcctcatctggcacaaaaggtacctttagcaggagctgcggatggcaacagaagtctcctgccctccagcctgagggtccctgataacatccaggaattgtttccattggctgggaggagaggcccccagtggctgtgcacagttctggccacatcctcaggagaaggaaacaaggaaggcaaaagcaacccagccagggacacagagcaggaacctctccagccgggggcggagggggctgctcccccagctccatctctcacctagcctaggaaggagctgcgcttggacccggcagccccgacctcgcaaccacgtacctgcccactgctcactgacatggctgggggttgagcaaatgtcttgagagcaaaagctcctggattgaaggaagtggggaggcctggcacctcctgggtctctcttcacaccccaatttccatcttctccagcatttactccacctggaaggcagaggctttaccctcagcactcactacagcgtcttccttcgctctgagggcagggattttatacccttcccacctcccaacctaaactatccccaggtggctcagcctggcctttgtacaaatgagtccctgcacctggatcactgtgctcacctgtcttcacctaattccaacttacttttccactctctggaaagcattctctgacccttcccaccccactatgggctcctgggcttgccccacctcaggtttcatcatcttatattgcaattccctggctgctggtctgttcttcccctcccctccccatcctctaagactatggggctcctgcagcatctctagtgcctggcccaggcatggtgctcaggaagaacacaatcaccctgttgtcctctgttcctctgccgggatgggagagtctggtagtcactttatcttttacagcagcaggtctcagactagagtgagcatcagaatccacttggtggtgcaggcagggagggacttattaaaatacagattctgggccctacccccagagtttctgattcagtaggtctggggtagggcctgagaactggtatttctaacaagttcccaagtgctgctgctggtccagggaccacactttaagaatcactgttggggctgggtgctgtggctcacgcctgtaatcccagcactttgggaagccaaggtgggtggatcacttgaggtcaggagttcgagaccagcttggccaacacggtgaaactccctctctactcaaaatacgaaaattagccgggcatggtggcacgaacctgtaaacctgtaatcccagctactcaggaggctgaggcaggagaatcacttgaacctgggaggcagaggttgcagtgagccaagattgcgtcactgcactccagcctgggtgaaagagcgagactccatctcaaaaaaaaaaaaaaaaaaaaagaatcactgttagcctggcatggtggctcacgcctgtaatcccagcacctttgggaggccaaggtgggtggatcacttgaggtcaggagtttgagatcagcctgcccaacatggtgaaaccccgtttctactaaaaatacaaaaattagctaggcgtggtggtgggcgcctgtaatcccagctacttgggaggctgaggcaggagaattgcttgaacctgggaggcagaggttgcagtgagccaagatcacacaaatccccatctcagggtgtcagtttcttcactggtaaaatgggataactactgtccccattatcctgggttttgtgaaaatccaatgagataatgcaaatgaagaactcatgcacccagtaggtgctcaataaatgttagcgatccctcctgggagtaggcaggagacatggcaggcagggaaagcatgaacaggagcagagatgggaaaggtcccaagcaggtcagctgggctggcagaagagccaaggcccagcacagcagccagggagtgtcctgtagaagtaactgggagccacgcacagttctggagctgggcagtgacaggtggaagctgaatgtggcaacatggggcagaggccattgccggcagcaagtcccacgtgctggagacttggctgtttggctagacatagggttgccagatttagcaaagaagataaagtatgtccagttaaatttgaatctcagatgaataatgaatactttcttttagtataagtatgtcccaaatattgcttgggtatacttatattaaaaagcagttgctgtgcatctgaaattcagatttacatgagtgtcctttatttttatttgctgaatctggcaatcccaactagacaccagttgcctgccccccagcccttagtcctgcatgcagtgggagacccagccccagggtccactgcctcccttcccaccttcaacaaagccaccaggagtgattgatgagctgctcccagaagccagtattgctgctctgagtgatcacaactacaggcctgggtaagggggccctctcacctcatgccaggttcacccagcaagaaagtagaggggcacagtcactaaccactgggtctgtaaattaacaaagcacatagggtgaatggaatgactcatcccaggactttgagaggcagagacaagaggattgcttgagcccaggagttcgggaccagcctgggtgacatagtgagacacccatccctacaaaaaatttttaaaaattagctagatgtggctgggcaccgtggctcacgcctgtaataccagcactttgggaggcccaggcgggtggatcatgaggtcaagagttcaagaccagcctggctaagatggcaaaactctatctctcctaaaaatacaaaaattagccaggcatggtggcaggcacctgtaatcccagctactcatgaggctgaagcaaataatcgcttgaacctgggaggcggaggttgcaataagccgagattgtgccactacactccagcctgggcaacagagcgagactctgtctctaaaaaaaaaaaaaaaaaaaaaaaaaagccaggtgtgatcatgcatgcctgtggtcccagctcctcgagaggctgaagtaggagaattgcttgagcccaggaggtcaagggtgcagtgagctgtgattgtgccactgcactccatcctgggtgacagagccagaccctgtctaaaacaaaacaaaaaaacaataaaacacataagctaccaaattctgtaaagaaggaagtaccacctgcattcttggattaatgaagaaacaaacagctgccagtgatataggctcatccgatgagtatacccaagcagaggaaaaaatggcctccaccttcaaccccagaaatgggcaaacacaagtgtccatgctgcttgcaccctcagagaaagccctggagatggtgatgtcaaccacaagctagagtgggacagtctctgccttattcagttccattcagtgttagaacaagtcatactagcagaggctgttctatctgcctttcttctcctaccctcatcaccaaatcccagatgattgagagttccagaaacgagcctgtcagaaatgcaatttttctttttctttttttttttttttgagacaatgtcttgctctgtcacccagggtggagtacagaggcgccatctcagctcactgcaacctccacctcctcggttcaagtgattctcctgcctcagcctcctgagtagctgagactacagctgtgcaccaccatgcctggctaattttttttttttttgtatttttaatagagacgggggaccgagcgcagtggctaacgcctgtaatcccaacactttgggaggctgaggtgggtggatcacgaggtcaggagatcgagaccatcctggctaacacagtgaaaccctgtctctactaaaaatacaaaaaattagctgggcatggggatgggcccctgtagtcccagctactcaggaggctgaggcaggagaatggcgtgaacccggaaagtggagcttgcagtgagcagagatggtgccactgcactccagcctgagtgacagagcgagacttcatctcaaaacaaaaacaaaaacaaaaaaacagagatggggtttcaccgtgttggccaggctggtctccaactcctgacctcagacgatccgcccacctctgcctcccaaagtgctgggattgcaggcgtaagccacctcaccccagccgcaaatgcaatttctgcaacaacctttatatcaactttttttcctctaacaatgaacaatgaaaacaatttgtgctccatctttaaaaatgtgtgacacaaaaattttttaaataaaaataaatatgtgataaacattcctgaatgcctagtgtgtgccctggcgctgtgctctgcatttaatttggatcagcagttctcagccttgtttgtacattacaaccaactggagaggtttttaaactcccagtatccggggcatcagtattcgtctagggcacagtgattctaacacacagtcaaggttgagaaccacttatttaattcatcctgtaaatcctcacaatagaatcctgcaaggtagcttttatcaccacctttgccgatgaaattgaggctcaaagaggtaaattgatttcggcatctgtagccccaacctgtgacctctccttccttccttctcgggctcccttcagggatttcctgatgttacagaaaatggtatgtatgacgctgccctcctggccaccttgacatagctctgctcccaacagggctcttctgagatagcagccagacactacctgggatcaggactgatactaaatgacttctgccaaaatgaggacaactgaggccagtcacttccaaacaggttctgtcaccctgagtcagaataatggcagctacctctcctcctcaccgcccagtcgtttctaagcctggctcgtcgccgttgctgctccgccaagcctttcctcggtgccctctctcttttagaacaaattacttcatctccaggcccttctcagggcagcttctttgcaggggccatagggcgtcggaaaggtctttggtccaggaaagccgcgagccacagatccaagaggaaaaagccgttcccggcccgggccttgcccaaggcacgagagtaaatgcaccttccgcgtgcctcggcgcacctgggctcacctgtcccctcccgcagtgcctgcagacagggagggagcgcggctgggccagaaggctgatcaccgcctgccccctgctggccagtgtcagtattgagcccgctgccgctcgaccagaacgtcccagggatggaatgaaggtgcgggcatttatggagcgcctgctgtttgtcaggcgaggtactgataagcgctggagtgtaaggatgtacgtgacctgctctcagagttcaaatttaaatgaagagatatacattaatcaagtagtcattcaagcaaatatgaaattacaactgtgggctatgcgaacagatgacgcgaggggcctgtccagtctgggagatacgggtgggttcaggaaaagctgcccccaggaggggacgtttgagcgccaggagccgcgcaaagtcatttcatgtcatctctaaaatcctgcaaggcggctttcccccttgacaaaacaggaaatgggatcaaattgaggaaggaattcacccaagatcacacagcaagctggaagcaaatctgggaggagctaggtccgccccgttccgaaatccacacttttctggaggtggggcaggcggtggcacagggacttggggcggggtctggtgggcggggcatgaagtctggccccgcccccgcctccgaggccaaagggcgccctgggcggggatcggagcaggggcggggtctttccagggagtggagcctgggcagattggggcctgtggaggccgcactaggatcgtagaaggagtggagccgtgctctcaccctgtcttagaggacccggaagcgccaagtgactgagggccgaagacactcacctgtggagcctgtgcacgtaggtagaggcggcggctctgagtccaggagctccagtgggcagctccccaggtagggcccaactcggggggagaagagatgaccctctcccctcccgccctgcccatctgtcctgccatcctacattccttccttcctgtccgcgggcctgggtccacccctagctgtaagatggggacgcaggggtggagggactggcctcattttgtccctttttccctggcccagcggctgcaggccccctggacacccagaacgtagagtctggagaggagacgtcgaaacctcccaggggaggctggcccagctttaccccagcctgactgtgtgaccttgaggaggacagccactttctctggtacccagtgtcctcagttgcaaaacagtgactggcccttgccctgcttgccctgagactgggcagatcagatgctgtagctgctgggggctggggtggcgctttctctctactggggcactaggagtgcttactctcctgctccctctggtcctcggtggagagccacacccttcatccacccaaacctgggagccccgagggctgagagcctagtcctagggcagcttgctctggcttccctgtgctagagttgtagtctagcctggaaggcctgtgaacatccccaaggtggggtgtgaggcctacgtggagtgcacatgctcgttttgcaaatagtggtgccaccattgtgcatggccttgagtgccaagttaagaagtccaaactccgctgggcgcggtggctcacgcctgtaatcccagcactttggagactgaggcgggtggatcatgaggtcaggagatcgagaccatcctaacacggtgaaaccccgtctccactaaaaatacaaaaaattagccgggtgtggtggcacacgcctgtagtcccagctactcgggaggctgaggcaggagaattgcttgaacccagcaggcggagcttgcagtgagccaaaatcatgccaccgcactccagtctgggtgacagggcaagactccatctcaaaaaaataaataaataaaagaagtccaaactctcaactgctggcaggggcagttcatcagagtatgacctgcagtgcccacaggaccagcctgcatgagtggggctgtcatgatgctgctgctgataggtgtacatacaggtttttattgcattccagggctttacacaaagtcattagttactcacacgtgcctgatgttattcccattttggaggctgagactgagggtcagagagatgaagtcacttgcccatggtcacagctagcaaatggcggagtggggatcagcacccagataatctggtgccttttctcctaatgtcctgtggccacccgtgatctgggcatctggttataaagtcttaacctaggacagctggagaaaggaggggctggatgagcaggaaattgggggagaagattcagagggctagggagggagagaggggtagtgactagtcctaaggggtattcggcttcctgggaaggtgtgaggagtgaagtggctgattttagacatgttagtttgtgggtggagggtgatagaggggagccaagcagagctctcctctgtctggaaaagaacaaggaggtagagctgggtcctgggaaaagggggtgcctaagggataggtgaagacagaggcgggctcacagaaggcccccaaaatgctgagcaggcagatgtgggggggctcactggaagcccccaaaatgctgagcaggcagatgtggggggctcacagaaggcccccaaaatgccgagcaggcagatgtgggggacatccattggtgaagtggggggaacagagagaggagagaattctggactcccgtgacattagatctgagggagatgggtctaaaaaactgaggccttggttcacagaaggggaaactgaggccagccagttacttgcctgagaatactccagggctggatccgagtaggaccccgggtgccatctctgctattcggccctttctactagatcgtggttctcagctgggggcaattttgtcccccaggagacatttaaaaatgtctgaagacaatttggctgtcacaacctggagctgcgggggatgaagtgctactggcatctaatgggcagagaccagggatgctgctgaatatcctacagtgcacccacccaccccccagcaaagaattatctggccccaaaggacagtaatgctgaagctgagaaactgcactagggcttaatagggcagaaagctcaggcttgggcctccagctggatggacctttgccccaaccccggctctgcccctccccatgcttgctccttaattcctggaagcctctggagtcctctctgcttttcctgggcacagtggtttagaggtctgcccaccaagtgtctgtcaccactctgtctccccagacctgtattcagagtttggcattaggtagggagaaaccaaagtggaaatgtcccatctagcacatggcaggtgccttgcagataaacttgatttgagtgacatcttaggggtccagggagtttcatttcatcccattttcactttggcaatttgaattgtgtcttatgtttgtgacgctctgacatagactgaaagaatccactgcttcatccgatgtcctaggatgggcaggatgtggcattatctgagaaatgctgtggaggtgggggtcttgtcgtttaggctcttccaagagtagactgtggactgggaacacaaaagcagttcctttcaaacacatgaaaggctgcaggaatcacctcgggatcctgttaaaatgcagatgctaggccaggtgcaatggctcacgcctgtagtcccggcactttggtaggccaaggtgggaggatcacttgagtccaggagtttgagaccaacgtgggcaacatagtgagaccctgtctctacaaaagaaatttaaaagttagccagttatggtggtacatgcctgtagtcccagctactcaggaggctgaggcaggaggatcactagagcctgggaggttgaggccgcagtgagtcattttggtgccactgcacaccagcctgggtaacagagtgagatcctgtctcaaaaaaaaaaaagaaaagaaaagaaaagaaaaatatgcagatgctgattcagtagggctgagttgggcctaagtttctgtttctaacaagctcccaggtgatgctgatgctgatgtttgttgctggtgcataccacattttgagtgcagggcattgcagggctgtgcagaagtggccatgggccatgcaaccaactcttgggtggtttggaagcatggagtggaaggagaccatgctctagagtcaggagagctggatatgagtctttactccctctctcccctccctataccccttctatggcctgtcagcttagaagagcttgaatagtttcctcacctgtaaagtcacttaaccttgggtaagtcacttagcttctttgctaagtggtcttgcatggcaggctgtcctccaggggttctgacccagggtctgagagaagaaagtgctctgtagagataggacagtctgggtcttggcaggcagaggggcagcaggccactggcctggccaggagggcaggggtgatcacctgaagctgctggggcaggcactgtgccagcttggaggaggctctcatcatagccctgttttttctctgaggccgcctcagcctcctgctttgggcttacccaggcctgtctggtgtgggaaagctggagagaccggtctggctgggggagggagcagcttcagtgggctgaggccagcccaaggcctgattgtgggtctgagcgcctagccagctcagccctggtctgaggagctggggttagggttgaaattggggtctgagaactatagcctggacaccgctggggtcaggctgtgcatggacaggcttcccaccagggaaactgggaaggaatttgtagtttggggccttaagcccccagctataggggatgctctgccttgagcatctgaccccaggaatggggctgaacagagccttgagtacctggggtgctcccacccttggtcccccataagtcagctacaatcgcccagcaagacaccttccaactcacaggaccagcagatagcaagacagctgagcccatttctcagatggaaaagtggaggctccttcgttcccacttcttgggaaaagaagagtactcattagcacagtcacccattatccagcagggccctgggcctgctatctaatgaggctgccccctcttcccaccccctccgttttcacagttggaccatcccagtggaaccacacaaacctgggttcagatctcaggttccctccttcatagttatgaggctctgggcaggtcactccacctctctgagcctctgctggctcatctgtaaacaggaataatgacacccgctcagccagccccacagggttgttgtgaagatgaaatgagccgtacccacggaacactgtggtcattatcattagtcatggcatttagaggcacgaggcaactgggtattgttttaccttgtgccctattttacagatgtggacatcggcacttggggaaggaggcggctgcccaagggtcccttagcagggcagtgggcaagctggggttagacccacatctacaggtgtacctcccatcgcacagctgctgccatctgtgcaaaggcactccaaggcgtgacacaaatgtaaacttgggggtctgtgtggtcaggctgcaggagcttcttgtggaggagctggagcagacctttgtgcaagccactgcctttctttgccagcaccagccatgaactacgtggggcagctggcggagacggtgtttgggacggtgaaggagctgtaccggggcctgaacccagccacactgagcggcggcattgacgtgctggtggtgaagcaggtggacggctcgttccggtgctcacccttccacgtgcgttttggcaagctgggcgtcctgcggtcgcgggagaaggtggtgagtgctcaggctggctgaggtggctactgcagagtgggctttttaagctggggcagccactacagtcccaggacaggacctggggcctcccttaggtggggatctgtcctctggacaggcttcccttcatttgtactttctttgaaggtttttgggttgatttgggggttttggtctgggagggttcacagttagtttctcatggaaacagaccagtagggctcatcccagtgctggggccgtcagacctggctcagcttactaagaccttacctgtgtgttcttggtaagtcacttcatgcctctgagcccagttacttcacctgcacaaatggatatgattttatcggcctaatgatgctggtgggacaagtcaatagcaactgataatactgtctcagggccagctatgtgggaaacactcaaatgttagtttctctctcttaataaatccacttcaggctgggcatggtggctcacgcctataatcccagcactttgggaggccgacgctggtggatcacctgaggtcaggagtttgagaccagcctggcccacatggtgaaacccagtctctaccaaaaatagaaaaattagccgggtgtggtggtgggcacctgtaatcccagccactccggaggctgaggcaggagaatcgcttgaatccaggaggcagagattgcagtgagccaagattgtgccattgcactctagcctgggcgacaagagcgaaactccgtctcaaaaaataaataaataaataaaaataaataaataaatccattccaccttcacagggctcaggcaagcacagcagagatttttgttagcagcaaggtctagggtgtgaatcaagattcacactgaggcaactgtgacgtttccaggatcctaatagaaaagtgtagcctatgggaaatagtatatctaagaggctagtagcttgggttgtagactcagcctttttggcttcataagctcacttgctgtgaggctgcctcctaaccaattactcaaacccccaaagcctcagtttcctcatctgtaaagtggaggtaatgataggagctactgcaaggggttgcagagattaaatgagataatctatagaaaacactccacaaagggccagtacactaaaattcccaccattgtttatgcagccaataacctgggggctggggacacagcgatcacaagagagaccacgtccctattcttatggatgtgagagacagagggaagaacttggaaaccaggcaatacacaagaagaccgagacagtgacaagtacaatgaggctcagacagtggggcagtgtgagtgagggagagatgggtagggagctcagtgaaggcctctctgaggaaggggagatgcagcagagccccccttcgtggggagcagccaggcacttgaggtccggagggagggaaccccagcaagtatggtgtttggggcggcaaggagccactggaggaccagccaggaggcctgtggtcggaagcatgggcgtgaaggcccatgtccctgccaccgctttccatttgcaggtagacattgagctcaatggggagcctgtggacttgcacatgaagcttggggacagcggggaggccttctttgttcaggagctggagagcgatgatgtgagtctgccctcctaacagcacctgccccgcccacccctttcctgtgcctcttctgggcagagccttgggatttgtcaccatcctcgcccttccccgggagcaccccaccagcagaggtctgaggcaggggtatcagttggggctggcctctggcacacgtgatatgctgtgggggcccagaggaagaggccagggtaccaactgactctatttactgggaagttggggaaggtttctcagaagactggacccctgagctgggcccctgtgggatgaaaaggaggccttccccaggcagcttgaagaggaggcgggagctgaagaaaggggctgggaagtataacatctggcttgtcctgggtctggtgccagctccgtgtggctggaacctagaagtgtgtaagtggtgggtgttcgcacaggggaggcagggcccagcagaagccagcagaggagttgaaacagaacttgaaaaactttgagtccctactgtaggccagacactgtgcaacagactcagatgacgggtgacccctgccttcaaagaaagttccaggctgttctgggagctagacacataaacaatggatgatgagccgtttggtcattgcagtgagggatgttgggattgggagagggatagtcaaggctccttcctggaggaggagacatatggctgaatcttaaagcagaagtagatgtctgctgtcatagacttgggtagaagaggagatcagaggccgatgccaagatctctgcctggcctgccagggtggcaggtggctctgttggggacctctgaggccagcagtggctacagggccaggctggtgcctccacacctgttttcctgaccctaaatgagctcactccagggctgggacccaggcaaggctcaagatgactgtgtggtgagcgcagccccactagggtcagcccccgacctcagttcttggtctgttccacaggaacatgtgcctcccggcctgtgcacctcacccatcccttgggggggtctgtctggcttcccctcggactcccagctgggcactgccagtgagcctgagggcctcgtcatggcaggcacggcctccactgggcggaggaagaggcgtcgcaggaggaaacccaagcagaaagaggatgcagtggcaactgattctagtccagaggaactggaggcaggcgctgagagtgagctatccctgccggaaaagctgaggccagagcccccagggtgtgtaaggaccaagggacttgaaccccagtttgggggttcaagtgctgtttcctctgctcatgctgtgtgactttgggcaagggccttgacctctctgagcagtagttgcttcaccttaccaagcccctgatgtccaggctctcatgcctgcctggggcatcctgcctgatcagtgaccatttccttgtggccccttagcagtgtccagttggaagagaagtcttcactgcagcccaaagacatctacccctactcggatggcgagtggcccccccaggccaggtaagagtccaggtgggctgcaggccaggactccagatcaaggtctgaggtttccatttgcatttttcctgatgactaatgacacaggacccatttaatgtgtttactagccattcgtatttttcctttgtaaagagttcaagtcttttattgatttttttaaattgcggtaaaatatacataacataaatttaccattttaactatttcaaagtgtatacagttcagtggcattaagtacattcagtgttgaatgaccatcaccactatctagttccagaacatcccatcccccaaatggaaaccctatgcccattaggcaatccagctacaactttgccatcttctttttttttccttccttcccttccttccttccttcctccctcccatccttcttcttactggattgtcttcttcttgttgattagtataagttattcatatatttgtatactctttagatctttacatattccttatatattatggattcaacacaggcataaatataggttgcacatatttttttccctggctggggtgggcagcagcggggatgggtaggcaggctcaaggcctctcaatatgtctcctgcagcctctcagcaggtgagctaacatcccctaagagcgactcggagctggaggtgcggaccccggagcccagtcccctaagagccgagtcccacatgcagtgggcctgggggaggctgcctaaggtgagtccctctgtatcaaccccaggcccggcctttcaggggctctgtggcccccatgggtcagggttggagggactgaaactcgggccactgccccaaaagctttgtggggcatgggccttaccctggcccacatcttcctccatttgttccactaaaggtggccagagctgagcggcccgagtcctcagtggtccttgaaggcagagctggggcaacctctcctcctcggggaggacccagcactccctctacctctgtggctggcggcgtggaccctttgggactcccaatccagcaaacagaggctggtgccgaccttcagcctgacacagaggatcccactctagtgggtccccctctccacaccccagagacagaggaaagcaagactcagagctctggggacatgggcctccctcctgcctccaagtcatggagctgggccactctggaggttccagttcccaccgggcagccagagagggtctccagggggaaaggtgagtgacgctgggtctctcccactgcctccctggcctcgctctgtcccctgggtgggtgctgggacttcaagtacattttgagcacctgctgtgtgctaggtgctgttcttggcaccagcctcatgaagctcacagtgcagtgtgggagacagatgctgcatgtgtggaagggcgtgccacaggcatagtcattggttggaatgggagctgtttaaaccaggtggtcagagaaggcccctccgagaaggtgatgttggagctaagacatggataatgaagattcagccaagtgaggagcaggggaagggaattctaggcagaggaaacagtatgtgccagggatgtaaggctggagagaagtttcatgtccagaaactgaaagcagctggcgtgccttgagcaagaaatggaagacggccgggataggaagttggggagatgagcagactcagatggctccagctcacaagctcaggtttatctaaaagtgctaggaaagcacgagacctgtgctgtccaaatcagtagccactggctatatgtggctatttaaaatcaaattagggacagcatggtggctcatgcctgtaatcccagcactttggaaggctgaggtgggaagattgcttgaggagttcaagatcaagcctgggcaatgtagtgagaacccatctctacaaaaaaaaaaaaattttttttttaactagccaggcatggtggcatgtgcctgtagtcccaactactgaggaggctgaggcaggagggtcacttgagcccaggagttcaaggctgcagcgagctatgatcatgcgatcacaccactgcactccagcctgggtgacagataaataaaaattaaaaattaaattaaattaattgcaattaaaatataaaattccattttttttttttttgagatggagtctcgctctgtcacccaggctggagtgcagtggtgcgacctcggctcactgcaacctctgcctcccgggttcaagtgattctccttcctcagcctcctgagtagctgggactacaggcacatgtcaccacgcccagctaatttttgtatttttagtagaaatggggtttcaccatgttggccaggatggtctcgatcccctgactttgtgatccacccgcctcagcctcccaaagtgctgggattacaggtgtgagccaccacgcccagcctagaattccatttctctgtcacacggtgatcacattttaagtgtgctcaatagccacatgtggctagcagctaatatatcaggcagtgcagacatgggacatttgtatcactgcagaaggttctgctgggcagcactgccttagagaattcagagtcagagggcacttactgtccacactgctgagcacatgtcagctctacagatatcctctcttcaactctcaggctccccaaagagaagccagcacctgggccccagtgacatctacctggatgacttgccctccctggactctgagaatgcagcgctttacttcccccaaaggtgcctgggttctggatgccagggtgtcttgggtctgggctcctggggccaagggtccactatcaagggcctgtgaggagggaggacccatctcccgccctcctcgtattcttgtcattgttggcccctttgcctgcagtgactctgggctgggggccagaagatggagtgaacccagcagtcagaagtccctgagggaccccaaccctgaacatgaacctgaacccactctggacacagtggatacaatagcactgtccctctgtggtggactggctgacagccgggacatctccctaggtatgttcgaccatggccaagcccttttgagggctggtgctgagcccagaggatggggagggcagggaagactgtgagggtggggcagtagaggtgagaggctgggcttccctgcagctctctgccctgtgcagtccacactccgccagcaggggctggaccttcccaagtccccatgaagcaaaatgcttgacgctaagttgtgagttatcctgtgaatcctggggtgggaacaggtgtaaaaaccacaggtagggaggagcactgccaggttacaaagccaaccgacaggaggtgagcagcagagtggggagcaccagggggctggggcagcgggtcacatgggatgtgccagcctcacccctcactctgcctctgtgcccagagaaattcaaccagcacagcgtctcttaccaggacctcaccaaaaaccccggacttttggatgacccaaacctagtggtgaaaatcaatggaaagtaagtcccagagctggggctgctggcagccggagagtcatttccctcttcacaaccctgcagctgctgcagcttgatgccctgttctgtctctctaggcattataactgggctgtggctgcccccatgatcctctccctgcaagccttccagaaaaacttgcccaaggtaatggttagagcaccactgcccctgctggggaaggtagccatagactcagggcacggagacccttagcaaggaagtgaagggtgagcagagatgggcctgggagccaggggctagctggctgcaagactcactctgggagaggcgacacacgtccctgaagccttgcctcacccttccctggtttcctggccgtggctgaatcctgttgtatttaaacttgacttcagaggagctcaggacaaaccagaggggaagaaaaatccaacagatgcttaaacaaggacatgtctttagcaggaggcctttgcatctgaaatatggggaagcctttggatctgaaatacggggtttgggaaatggaagttgcacccttcaccttgcctgaagactattcctccaggctgggctgaagggtgcttactttctttatctgcacacatttcttgagtacctactatgtcccaggcctaggctggggacagtcatgaataaacgaaacaaaattatccctgctctcaaaggaagacgaagttaaccaaagactcatccagatgaatataattcagtcctgagcactgggaaggatgggtgtgcagtgcttgcagagcctatggcaagggggtttgataagcaagtgcccgctgtgcagagattgaaggatgggtgggccttgagctggccaggggtggggaacagcatgtatgatgcccagagggggaaaggaatgagggtatgcctagcctctttactcttcccagaacctcttccctggtcttcccagccaccttcccctactcatggaggatggtgccctcctgggcagtgccagcctgtgccaacctgcacctgcccctctgggagcaatccaaggcaccacactgacctggcatggcctattgttcttggcttgcccaaagagcatcactaacagatgttgacagctgtcactgccattgggtgacagctttgtcctctggctggtacagggtctgaggtaggacccagagtctgtgggaaggaagagggtcccttccctgcttggatctcctcaccttacccagacagacccaccgcttgaggcccctgagagacccctaccccaccagcctgttcccagctcaagggggccccctggctattcccagcccaagcccacatcctcctgacttgggtctgtaggatgctggtgtgtcccccagatgggacttggcctggcctctccctggggttatctataatagcatagatctaatcagcattttttcacaaggtcaacttgcccccaaccagacagttatggtaacatacagaaaagggggttgttcatggaataggatcaccaaccttaggaggttgcctggggcagtcttggaggttgaggggagtaccagctaaagattgttctccctgctgccacttggtcacagcatagggagtaccagatcttgagaaactcccaaagcattgcttttaactactctagtaaaggaatggatccacaagatttggaggccaggctgaggctgggttagagctagggaccggggctgggggcaggaatagcccttggtcttttgagtatagctcacccaagtcattgcttggaatcccaggatggaggtgagcacacttccttggcctccagatgttgacagcaccttaccctagggttggctcagactctgggctcatgcgtggagggtcccaagaacaacgtaaggtaggaggtttatgtggtgcaggaaacactgccatggctttcatctgcccacagagcaccatggacaagctggagagggagaagatgccccggaagggtgggcgatggtggttttcctggcgacgcagggacttcctggccgaggaggtgggtggtcacagtcgagggccagggccagggccagcacagggcgggaggtgggattcactaatggatgttctttccacagcgcagtgcccagaaggagaagactgcagccaaggagcagcaggggtgagtgagaccccctattggggctctgcagggggagcctgggaaagatggccctgggtgcaggtgggtggcagggaggagccagcaccctgtctccagctgtgggtttttttttttgtcattcctcaagcaccaagcacttctttttttgttgtttttgtttgtttttgagacagagtctggctctgtcacccaggctggagtgcagtggtacgatcttggctcactgcaacctccacctcccgggttcaagcgattttcctgcctcagcctcctgagtagctgggattacaggtgcccgccaccacacctggctacttttgtatttttagtgagacagggtttcaccctgttggtcaggctggtcttgaacttctgacctcaggtgatctgcccaccttggcatcccagagtgttgggattacaggcgtgagccaccgcaagcacttctataccttttctttctcctgagaaatggccccattttacagatgggaaaaatgaggcctagagacacatttcctggccaacaaccaggaaatggcagagctgacacaggtcctcaggctcctgccccagacaaggggatccctattaaggaggggcagggcctctcgcagcccaaataagccagctgactttgtttcttttccacatctgaagtgacccagctgcctaaggctgggtggagagtagctaaggatggcctgactgaaaccaaagcaggtggggttgggaataagcccagagatacactttaggtatttcaggtaaatatctccaaggcagacactgagggctggcaaccctgggtctcggcaccctctgctgtcacttggctgggtggagactgccagcctgcacccctgtgtctgccaccactccaaatgggttgcacctagagggagggatcactgataccctgggtaggccctggcatggcggggacaggtccagcctcctcttggcatctcccgggagtgaaggccctttggctggaggagatggcctgagagccagtgtggtccacagggagaagacagaagtcctgagcagtgatgacgatgccccagacagccctgtgatcctggagatcccctccttgccaccctccactccaccctccactcctacctacaagaagtccctccgcctctcctccgatcagatcgtaagtgtgggttgtctgtgtggaggttggggaggggctgagctaattctgtcttagagtccctcaggacctggctgagaaatggctccagggagccacatgttcaccaaaggccagaatctatccccttgggagcctccctgatggcctccacttgaatacctccaagggcagggcgctcacttctcatgacagcccatttgtctgtcagacaccgggaaagctgtctcttaggtcctcctaagatatcaacctgtagtgagccagcaggctctaggtcagcccttggaagcaacactaaaaagaatcaaatgctaatgacagcccctcagattctggcaacccttggccccaagtcacctcttctctaagctcagtaactggtggctcctggaataagaacatattttcttcatggttgtggctccatggtcagggaagtgtccaggaggggctgaccagccagtacaaagcagctgccatctgtctggtaccctggagctcacactcaactcagggctttggtgggaagcggccctgatccttccctatggatcaagtacagggttaggcctctccttaggacaatgttgactcaggtaccctggccccaaggaggggcttcctatggagatccccacaggacccccatctatggaggggggtgttttcctgccaacagcagtcccagccttggggctggcctgggaatcctgggcagggagtcatggatgcggctttgtgggttacatctcaaaggggagtgaagggaggctagggctcctgtggcctgcactggacagggccctgatcagcatggccaccctctgcccacatggatgtgtctgtgcatggctatctctgatgaatccaagaagcatctctgagctgggaggaagaggagaatgagaggcccgaggggatcggaggccacggcgtaaggggagaggtaggcagtgcctggctgtcatcaatcacgacacacccccctttgtctggcctcagcggcgcctgaacctgcaagaaggtgccaatgatgtggtcttcagcgtgaccactcagtaccagggcacctgccgctgcaaggccaccatctacctgtggaaatgggacgacaaggtggtcatctctgacatcgacggcaccatcaccaagtgaggcccacccagctgtgggaaggggagggagaggggttgtggactcgcctccctctgtgctgggtgtggtggggagtgagaggagccctcccttcctggtgggccatcctggggctggagctgggccacgtggagctgccttggagtaacccttcctctctcactctaggtcagatgctctgggccatatcctgccccagctggggaaagactggacacaccagggcatcaccagtctctatcacaaaatccaactgtgagtgcctgggctggggctggggctgaggcgaggcccccagctctagagagggagtgacaggacaggacatcttggggaccagcagggcccacaaggcaggctgccagggcaggtgcctggagtgctgagacctctctattggcccgcagttctgggaaaggctcatcccctggggctgtgttctaggatcagggcccacctactggcctgcagccggaggggaggccctctccatcctggtccacccaggcctcaggactctgtgcaccgtccagctgagtccactgcctggccgttctcttcaagtcccctccctgcaaaggttggaacatcagagtcccacagttgggctgggcaggctaaagccagagaaacagatgggggctggctggtctctgatggctctatgccaccctgtcccccactctcagaaatgggtacaagttcctgtactgctcggcgcgggccattggcatggcggacctcaccaaggggtacctgcagtgggtgagcgaggggggctgtagcctccccaagggccccatccttctgtctcccagcagcctcttctctgccctccacaggtaaccacccctacacatacaagcccgtggccccctggtggggaaaggcaggcccactgccaggccagccttagcaggctggcattaagctctcaggtggcaaggagggtggggtcagaccccccatcacctgagcctgccatcccctctggcttcttccctactttggcccccttccctgctgtggttctggccaccccagagaggtgatcgagaagaaaccagaggtgttcaaggtcgcctgcctgagtgacatccagcagctgtttctgccccacggacagcccttctatgctgcctttgggaataggcccaatgtgagtgtgtcccctccactctgctgagccacctctccccagctgcctgcaggcctccattccatgggcccctcctgtctcccacaggatgtctttgcctaccggcaggtgggcctgcctgagtcacgcatcttcacagtcaacccccggggagagctcatccaggagctcataaagaaccacaaatccacgtgaggctaaaccctgccatgttccccatgccctaccacgtccccctgccctggcttctccctgggccccaattttacctcttaccggggagtctgtcccttactctgggacagacccatggccaaggccatcgtttggtggcagctcaggctcagtgctggcccccttctgcctgtaggtatgagcggcttggtgaagtggtcgagctcctcttcccacctgtggcccgtggccccagcacagacctggccaaccctgaatacagtaacttctgctactggcgggagccactgcctgctgtggaccttgataccctggactgaacctgccctggctggctcctcctccctggcccggcccaggactggctaggtgtcctggggtataggagggtgggaattggagtgtcatggggcaaacccactgaaggggaaggaggaggctgcaggttggttggcagctagagagactcccccatcttccccgtcatatttttgccagctaagctgcagctgctccaggcgtcagtgtggcactgtcctggggcaattagcttgtcatctgggcccttgcagggttctttttttttttttttttttttttttcctgagacagggtcttgttctgttgcccaggctggagtgcagtggcatgatctctcggctcactgcaacctccgcctcccgggttcaagcgattcacctgcctcagcctcccaagtagctgggattacaggcgtgtaccaccacgcctggctaattttcgtgtttttagtagagatgggttttcaccacattggccaggctggtctcgaactcctgacctcaagtgatttgcccacctcggcctcccaaagtgctgggattacaggcatgagctaccatgccaggcctccttgcagggttttctatgcccttgatatctgtctccctgtcaacctgggaccttgctgtaagtcttgataggacagggagaagagggaggccctaccgaggctcgaggcttcagtgaagggtgacagcagtgggagtgtggtacagcctctggaaggacacagtgttctccccgccccttgtctgggagccaggactgtaccctccgaagccagacatcactgccaacatatcccccttgctggtgccctggcatctcagcacatgacacacacccacacctgcaggctgtggttccggcttggcctgctccccgtccggctgctgccgctgcctctctccagacctcgcttaaggacagtcccaaactcagctggggcaggtgttggcctgaaagtcctcccccagcctctgctggccagcttggtgctcacagctgctgggtaagctcttgcctaaggagctgtgggaagcagggctgatgccccagcaacctctcctcccactgtctttgaagaaagtagctttagaccggctaaaagctttaatccagagcctgccctactctgatagtaccagagtggagggcagaataccaaatgtccaggaaccaaaggcagggctgtggggacctgaagagcagcacagtggggcccgtgctgctgtgggggaaactgaggctgggagcctcagcagagaccggtgtcaagagtctctgggaactgcataggcctgaggaacatgcattttcaagttgtccattgatggtttcgtacctgaatttctcaccttttgtgaacatcttgggagggtgggggttttgcaggggtgttaaaagcaaggcttggagcccctttcctccagctggtggctccttctcagggcctggcctcattcaggccactttgtagagaaatgccctgacctcgcaggaaggatttccccacccccaagtggaaggaagaggacagtgtgggcaccagagggccctggaaacatcttaggggaaggaaaggaaaaggataaatttggagtggggggtctctaaacagattgcctggattccgttctttcctggggttctacagctgcctaagccctcaccttgggggaggatcaaagggaataaagagaactcttggctgagtctttgtgcttctgttctgtcctgaaggacacgtgaggagccagaaacatctggcagcctctggtccttagttcagatacaacatccatgaagctgccaggtgtgaggagagttccagtgggcatcaccttcctgcacaaacctagtcctgatggctgcgaagagaagccgaggggacaaggaacagaagccaccaagggctgtggactgttgcttgtgggcacagggcaatgcggacaggccactggctgtgggcctgtaggtctctgcacagttgctgaggctggtgctgactgcctgcagggtcctctcaaggccttacatacggacactgatcaaggccagtttgccacagcagctgcccctgccagccatgctcaggccctgcagctggctgtccagacactgatttgctgacagtggaatgtgaactctctcaagtctaccctggccttcaagcatgacatccttgccttgaccgctgtccggaactgtccagtttctgcagcactgtgcatgggttttggtggctgggacagccacgtggaggattccctcagtggcctccttagtgccatttgggctagccagggaaggctggaaggcgctgctggataaggctgggctctggggtgatgttccccgagttggtgggatctaggggttgggtcctggccagcctgtctagttggcttgccctggccgcacctgctcagccagctgggcctggcagtccagtaggtcatcccggaggcgggcaatgtcctgcgtgtgctgggccagcgtacgattcagctggtccacatggctccacaggccctctctgggcctcagtggctcagtgggcaagctgtccaggcccgcggccagcaggcccagcctcctgcacgcaccctccacttgtgccacccgctggtcaaagtgtcccactgtgtgctgaagtttctgggctgtgtcctggcagcggctcagcccactggccaccttggccacaccagccttgagttgctccagctccccacgcaggttcaggacctgcctgtggccagcctgaagcctggagccttggctgctgacctgctcctggatggcctggacttcggcttccaccttgcgttcccgctcatccagggacgtgttggcagccaagaaggcatcagagtactggctgacagagtcactgaggcctgtgagcgacttgctcactgagttcagattgaccttgagcagagtgatctcgccttgaagtgagctgcccgtcccttctgccagctgtccctggacctcggccacagtgccattgagctgctggagcagtgctgcgtggctggccacctggcgtaggagggcctcgctccggctctgccaggccttcacctctgccacgaggctgtccaggatggctgaggtggtgctcggggtgcacgaagtctccagtgagaccaaccgttgctctagcacagccagctctgtctgtacaaggggccgagctgacctgcccggagaggcgctgtcatggcttagctccccagccaatgttgctaggcgctcctcgaggctctgcacgcgctcttccagcatggtcccaaagccgcccactccccacccccccatgtccaacctcagacagcatccccttgctccaccctctgtcccattgagcgtctccagaccctcaagcagcccgtccacacctccctcgagcatggcagcagagagcctcgtaagctcatccccggccggggcaccggggcccctttgggtctcggtgactgcctgcagggccctctcaaggccatccatacgggcattgatcaaggctagttgcccacagcagctgcccctgccagacacgctcaggccctgcagctggctgcccagctgtgacagctcctggcgcagggccagctcccggccatcaaggctctggtgcagcctccggctggcggcctgaccctcctcacattgccgccgtacctcctgcacccgcaggtcacactcactctggacgccttgcagcttctgctcaaagccatccagcaggctcccccagagtcggtgcagccgtcggtccacgtactcctccagcagggccagggaggtgagcggggatggtggggcttcccgcagccgctgcaggtgggcctcatggccaagtgccagcccatgcaccttgtctagaagctgcaccttggtctgaagagtgttgctcacctctgtcaccttgcttaggatctcgtctaagggaggtgttagtggccctctggctctgtctcctgggcccacaagcccctcagggatgaccccaaagcccacagggacagcaggagccctggggccaccagtcatcctgttgggatcctcgtggctagccaccaggccactgagggtaccatatgtttgagccaggcgctggacatcaccctccaggcgttccagccgctcaccaaacagccctgggcctttccttcctgggaaagagaagagagccccaggggcatcactggcctcaccctctcagcttgtcacaatgccaggccacccaagagactttctgttctttttttttttttttgagacagagtcttgctcagtcgcccaggctggagtgcagtggtgtgctcttggctcactgcaagctccgccttccgggttcatgccattctcctgcctcagcctcccaagcagctgggactacaggcacccaccaccacgcccggctattttttttctatctttagtagagatggggtttcacgatgttagccaggatggtctcgatctcctaacctcgtgatccacccgcctcggcctcccaaagtgctgggattacaggcatgagccaccgcgcccagcccagactttctgttctaagcctaccttctcactgggcataactccctcagctttatggtggggtgaaagtggggcttggggcttgcccctccccatccatgccggagctcagccagcctgggatcagtcccctccctgcccctgccactgagcccaagaaacccaatcaccttggagggtctccttgggcagactcaccatgagggctgggggctgctctgctgtaggaagggggcctggggcctgggtccagctgccctgaaggaatctgaggctcaggctccagctggggtgaggcagccccatggtccgtgaggtgctcagggcagcgtttcccagtgaagccgggacagcaacgccaggcgaggtctgtcactgtcttgtagccaaccttgtatttgggtctgagtactgtgcggtacctgggccagggagggcaagagagtgggatcctgcacctgagggctgtgcttctccccctagctggcactcagggccgccctcagacacttgcataaggctgggtatctccccacctccatagcacccccagggctgtactttttctgtgcttaaggtgacaggggtgggtaagggcaggccttcctgaagctcacagtcatgttagggaaggatgcaggtagaagtcccacccatcctggtagcttggagagaagcaggaattttgccccatccctcccaagaccacttggaccccctctagctcaggctgccatgagaaattccactcaggctgcagtagcacctgggagaatcagacacagccccagccctccctgtgggcagggaggggcactgccctggagctggcgctggcagccccctcactgccctgggggccactcttggctcctacctgctccccttagttctttccactcctctctagcctgctccgggacctcggctctggtcagagaggcagatggacgggtacctctgattgtgagcagggaagggaaggtccagggtacaggcaggctcgcgagggtccatgccctcactgttcagccacgtacctgttcacccactgacacaccggagacaacaggtttgtttccacacacacacgtgaacctctccaggtacagagctgtgcatcccatgtgcgtgcagccctgctgctccggcttcctctccctgccccatggcctgcctccttgtggtcaccacagtcctccctgggcctgccaggcccccctgtggcatcacccgttgcctaaggggccctctgctccctcctctcccctcaccttctgcctctgtcacttcctcctagccttgtgctgcctctgcccccagaaccttccccttgtccctctgtggttcctgggctccaacccaagcctgcccctgtctgtgcgggtgatgctctgctgcaagcccaaatccctggggtcctccttggcaccctcttttctggggccgccttctactctggcctgtatgggggctcaggtgggctctctggagtccaagaagccccttgtggagttggcagctgctctcagctgaaggcaggactggcgcttgtgccaggggattccaagtgtgtaggtgaggagtgcacttacgtgactgtcccggggcacttgggcccccatctacactgccggtattcagcctttacgtagctctccgctccctcctgtaggatgcaggtcacattcctgtgcaccacataggcacagagggccctacaggagaaaatggcacccctggaatatctggctgagcgaggcccacagaggcgcctaccctcccacctccatctgtgggcctcagcaggactccaaactcccatgtctcttctgtctgttctctgtgtccctgggagccaacgcccttggtctggggtccagccccgctgctggtctctgattccagcctccgtgatgggtggcccctgggctaagcactatttggaaccaggagcctgatgtggctgcccctccctgcgtggggaagaggccagcccggattctccctcaagtgccctgccacacccccccatccttcgctgattccaaactccttatcttggcatttaaggcttccgagtccccactcagtgactcctttgagagcaccatgtcttgtccttcctccctgcctggctcccggggaaatccacctctcctcgtagttttgcagcccctgcctttggtcctgttcccttactctcagagcagttcttgtaccacctcctccaggaggctcgctgtgatgtacccaggcccactgagtgtcggtactcttcctcctacaacagctctcaaattcagctagaattcaagttcagccagcaccccaggcagagcctccagcccacttaactgaggccagttcgcaagccactgcccacgaaacaccagaagctgaggcggggaaagcaggctccttgatgagccacaagggctgaggaggtggctgcctggcataagccgaccgctgtggacggctgtgccacagcacaggcccggagccaggagcccgctctggctctgcagcccggccacgctggggctcccatggggttgctggggccaggctgactgcgagagggcagcggccgcccggatgcgcagctctatctcctacctggccgggccaggggagagaagggaggcccggggcgggggagccccgcgtgctcagcgcgcggaccgcctttcctcctctccctccacctggtccgctcgcccggagtctgcacacagcgcagctggaaaatgttacttcgctggaaaggtttccgctggcactgccaggatcccaagccgccgcgccaggccccctcggttcctttttcctcgccagccccgcaacctcccggagcgtagggcgctcgcctgggcaggggctcggccccgggcgccgccccctctgtgcagcggcctcggggtgcccggggcctcgacgccccccgcgggtgcgggcaggtgggagcggcgacgcgcgcgggcccatccctccctcttcccgcccgccgcccgcccgcgcttacttgtgcggccccgggcgcagccgcgggcgccatcccgtcgtgtagagactgtagcgggaggcaccgggcggcgcaggccgcgccaggagcggggtgcccctggcctgcgcccccgagagcagcgccgcgacggcgcacagccagacgagcaggcggcggcggcccatagcggcccccgcgcctctgcccggccccgcgcggtgccccccgccgggtgtccgcctgcagcgccgcgccgcccccgccgctggtcggcccgggtcccgccccgagggtcccggggtccccttcggcccccgagctcgctggcccggccgcctggcgcttcgcggcggctgcgtcccgcggagtggccggcgctgctagcggctggggccgcggaggggaggcgggaggcgggctctttgcggattagcataaacttggggccgcgccgctcgccgccgccagcccctcgccccagctccgagcggacggccgaggagccgcctgcgaacaggaggttccaaagggagcagccccaggtggcaggggcgcaggccgccgcgccctgggaggccccccgagcacaccagccactctgtcgcctgcgggcacggggcgagacgcagagaagcggacccctgaggccagcctgggcgtggactttccaggagtcgtccaccctcaggatacgcttgtcttcagagtccgtgtgaacccgggaactgctctccagggctctggagccgagatggccgtgactgggggcacagcagcaccacctcccccgccacctctttggaatagaccccagatcatccccgtttgctcgctctgcctcctggccccatcattgcccgggaaccttagtttgataactccgctgacctctccccaggcatcccacctcccccttaccccgcaacctctgccacgtagcctggtggcccggttgcacctctggttctctggaggcgcctgtgttgcctctctgtcttaggtatgggttgcaccgagcccgaaaggcctatcaccgccccagcccagccaaaagtgctgtgcttttcgtgcaactgaagctctaagccggctggtcagagaaaatcctcaggtctttctcacaaggcactgccgcggtgaagccaggcgtcgtccacattttgcttgtgaagttgactcttggaacccaagagttgggttttatcgtcgtcctcattcagtatcaccttgctaactctctaacctgcacagagtccttctgattctgtcatcagagcggtactttcctggccttgtctcatccacaccggtggctacagccgtctgtgtctttgccccaggagctgataggtgtacagaactctggggcttgcttggagagacctccctccaaattgaccttgagatatgaattaatgccttttggatagggtgatggttatcaaggatactggaaggggcagctccgaaacccacatctatttcctgcccttagctttagtggcttttgggttctgtggggcggacatctgaccccagctaggcccatcctgctttcccccaggctttggaatcagaacacagaagctgaaggaatccagcttccaggtgtaggttgtgtgagtttctcagggctgtggtaacagccacagactcagtggcttaacacacagaaatgtattcttgcacatttctggaggctaactccaaaatccatgggccagcagggcaatgccccctccagtggctctggggagaagccttccttgcctcttccagccactggtggttcctggcaatctctggcgttctttggtcaaggattctttgtagcagcatcactccagcctctactttccctccgcatatccctcttcaggtgacctttttttctctgtgactgtgatctgtgtcctttcctcttctttctgtttttgttttttgagccagagtctcgctctgtcgcccaggctggagtgcagtggcgcgatctcggctcactgcaagctctgcctcccgggttcacgccattctcctgcctcagcctcccgagtggctgggactacaggcgcccgccataatgcccagctaatttttttgtattttttttttttttttagtagagacgtggtttcaccgtgttagccaggatggtctcgatctcctgatctcgtgatccgtccgcctcggcctcccaaagtgctaggattacaggcgtgagccaccgcgccctgcctttctggttgtgtttttaaatttgagacagggctgggcgcgatggctcatgcctgtaatcccagcactttgggaggccgaggtggggggatcacctgaggtcaggagtttgagaccagcctggccaatatggtgaaaccccatctctactaaaaataaaaaaattagccgggcgtggtggcgggcgcctgtaatcccagctacctgggaggctgaggcaagagaatcacttgaaccctggaggtggaggttgcaatgagccgagatcatgccattgcactccagcctgggtgacaagagcgaaactccatctccataaataaataaataaatagagacaaggtctagctccatcacccaggctggaatgcagcgtcgacctcctgagctcaagtgatcctcctgcccccacctcctctgtagctgggaccacagttgtgcaccaccatgcacagctcatttttaaaatttctgtagagatgggctctcactttgttgcccaagctggtcacaaactcctgagctcaagtgatgctctcacctcagtctcccaaattgctaggattctaggcgtgagccactgcacccagcccagcctcctcttcttataaggacaccagtcattggatgtacagcccaacataacctcatctcaaatgattacgtctacaaagaccctatttccaaataaggtcacattctgaggttccaaatgttcatgaattttgggaggggcacaattcaatccactacaggggcacttggctggtaatgataggagagaccacgagagctctgggggaatcatgggaaagggagaaagagtgtggtcaggggagagaggggcagagtcaggggctatgtggtgagtaaccatctggggacaagctgtgacttccctatctgcttccagtagtccaccattggagctagcttgaatgggtttctgatcccagcaaccaaatgtgctctacagagagaaacttctctagtcatgaactgtagaaatgatccctgaaagtatagtcttacagcaaccacatggtccctaagacagcctttcactctccctataaaagcaccgaatgtgctattatatgctccaacctctaagagagatgttatgaaccattttgctgagggcaagatacaccatatccccaacaagctcttgatcttgtaaccactgactttgcgctttttaggaagtgagaaacatctgagccagctcctcatcctaggctgggtgctgactgcctggcagcattgcccagcctggctctgggaggaactcccccaccccagaggctgtgatctttttccaagtggtcccaccccttcctctcactcccttccccagccccagatgtggggcccaaaactcacaaggaagaggctggaccctgtttgagcttggaaatatccacgtcataggggctaaaaggatagctggaccccacttccccctttcccaggtggctgacatcaaacaccatgctccctctttcactgcaacagttttgggatccaggatctgggccccattctagtgggggtggaggacctcagtacagggagatgctcagggtcttggctggatcaggccagagcgggggtccccccatagacgatgaggccactttgcatctgccagacaggaaacctagggaggccagaagcagaggaggaaaggaggcagtcatgttcctctgactcagactggagtttctacacctggatggaaacgggccatacacgggagtgggagtgcagtttcagttcacagggacatgcacaaccacacccaacccatcccccataccactatcatgcatgtgcatgagtttttcctttcgtacagatggggtctcactatgctgcctaggctagtctcagactcctggcctcaagtgatcctcctgctttggcctcccaaagtattgggactgcaggggtgagccctatgcatcctgcctttcttttctgttcttttcttttttttcttttctttttttttttttacggagtctcactctgttgcccaggctggagtgcagtggcgtgatctcggctcactgcaacctctgcctcccaggttcaagcaattctcctgactcagcctcccaagcagctgggattacaggcacatgccaccacgcctggctaattttttgtatttcttttttttttttttagtagagacagggtttcgccatgttagccaggctggtctcaaatgatccgcccaccttggcctcctaaagtgctgggattacaggcatgagccaccacatctggcctttccttttcttattgagggcccagcacataagagtattaaaaaccacacaaagttgtatgggatgcagttcccctaaaagagacagaaatagaaagcactgaagctgctggctttctggtacaagctcttcctgctgcagatggacccctcctgcacagggaccacagcccttgaaggcaccagccctaaggtgcagccctttgtccctgaccatctcccttaccctctttttttttcttttttgagagtgcacagctaggcctccctgcccacagagccacatttggaagttctgtgcagcaaggctctttgcccaggctcacttttttctccacatcatcaccatcagcattttgattatatctgcaccatcataaaaggttataccaaatgcacatgagtttctgaggcaggggtttgcactgaccccatccagctaggcagaagcagggctcgtccaggatcctaggggggatagatgtgcagcctggaggcaaggtcctggaagagtccagaaatcgtggaaactgggctctgtaaagcctggacggacttccattgagtgagagtagcttaggaacagcttagaaattgtgactgctgatggactgtcaacatggacatatgcaaaccagatgcaacattacgcaaattatatacaaaatacatgcacaggtctcccaactattgcaaatgccagatatggtccttgaggaccctaagtttagctgagacctgttgtggggcagagagatcaccctggacttgccagtttctttttttttttttgagactgagtctcactctgttgcccaggctggagtgcagtggcgtgatcttggctcactgcaacctccgactcccaggttcaagtcattctcgtgcctcagcctctggagtagctggcactacaagcgtgagccaccacgcccagctaatttttgtattttcagtagagatggggtttcaccatgttggccaggccggtcttgaactcttgacctcaagtgatccacctgccttggcctcccaaagtgctgggattacaggcatgagccactgcacctagctaggacttgccagttttcttatggtgggcaggaagggctttgctccaaggtggttcacacactgtggggaagaaatcaggcaaggagtcaattagactcaggtttgaatcccagctcttccactcacaagttgcatgacctcccttgagtcacttcacccctctgagcctctgctttcctatacgaaaatgattattatgaggaatagatgagaactttggccaaggctcccatgtgcacagtcgtgcacataacagacgcccagtgagtgtggcagggctctgcacagagtcctttcttgggggttggatatctgggcctcctttctagtcactgcagtagcagctgtgccccctcaggctgtgggcaggaccttcttgcaaagcagcacatgcagctctgggtttggaaaatgtcagtgcttggatggaccaggaatccatgtacctctcactcgtcaagaaatctggcagaggtcacactcaacaggggtgctgtgggtaccccagccagactccctttccctggtcagtgtacccatgaatcccctggctgcaggtgtgattactgggaatgctcccagctgccccttctgtgaattgcccttggctgaggagtgactggctgatagggtgaaatggtttggctgtgtccccacccaaatctcatcttgaattgtaactctcacaattcccatgtgtcgtgggaggaacctggtgggaggtgattggattatgggggcaggtctttcctgcactgttctcatgatagtgattcagtctcacaagatctgatggttttaaaaaggggagtttccctgcacaagcgctcttttcttgtctgccgccatgtgagatgtgcctttcaccttccaccatgattgtgaggcctccccagccacgtagctgtaagtccaataaacctctttcttttgtaaactgcccagtctagaatatgtctttatcagcagtgtgaaaatggactaatatacagggggacaaaaaaggcagcctcctcgcctcatggtggacagcccagtgttagtttatgttgcagagcccccttggtcaggcccctctagactctacctgggatccattcttgctctatttccatcctctcctgttttcctacctcccttatgtatctctcccaggagcccccttgataaatgacttataactagatccctgtctcaggatctgcttttgtggaacccaacccaagagagggggacagacctgcatgcagagggggacatgaacttgtatagtcaggaaccatagggtagcgtgggctcacagaggaagaagtgcctgggtgcctgagcttgggggaagggatcagagggtgtttcacaaaacaggcaacactagagttcaccgcacggggagaaagcaccgtgggtggtgggtgcggcatgtgcatggcctggaggcaggagagagcctggtatgtatggggaaccccgcagagctctgggtagcccaggctccaagagaggttggcaggggccagacaagaggggccttgaataccccagtgaaaagtctggactttacagctggaaacgatgcatgcagaactgtcgggaaaaacatcctgtggctgcagctgtgtggagcagacacacgaggtggggtgccggtggggtggccctggcagctgtcagccaccaggctaacagggaccgagggatgaggaacagggctagattctagaggctttcaggacaaaggactaaaaggccttggtggctaatctggggctctgggtgtgggaaggagtctagaaggtaccacaaagagaggagacaaaacatcagggctgaggcagggttgaatgagctgtacagggcaggggtctgcattccctgtgcccaccacagctagagccaggctgagcctccagttggaaggtccggacactgaccagagtatgtggcacagctggcctgaccccagtaaggacctggggctgccccttgctggaggggctggcctccaggcctgattaggacagggatggggagaggctgggggcgggggagtagagtgcagagctgctcaggcattgatgcgggggtgtggttgcaaggccctgggaagggctcaccatcagctctcctctaactcttctattcatggacaccagagtaaaaactacacaagattacccactggtgatgggggaggcaggcttgcaatgcagggtgtgtgcagagaggccaaaacaagcaggggagggggctaccctccatggggggaaggaaggggagggtgttgccatggaagactcatgcttggacaggcagaacctgaccttcacccagacactgtccttatctcagacctgctctgccttaattccttaatttgctgggacatttgctgggcacccggtgctggaagcacagacaggtcggctccaggctctgtgctcaaggcatccagaggggcagaggtggatgagagttagagaagccccaggaggggccagaaaggggcctggggaggtgagaggggaaagagcatccatggtgggagacacatgctccaatcagagggaggggacttaggaggggacatggcaggaggggagagggctgcgtgcaggctgaggacttgaggaggctgggggttgctgcattttgatgcttggccttcagccccttgaatccactccagaccacttcctagtgccactgccattgtctatttctgagtcgagctccaatccagactggcagtcctggatgcggggggccatctcttgcccaagtttgccagatgaatggaccgtgggtgttagatgggtcattctgtagccatgaggagatggcactaggcaggctggcactggcatccaggcaagagatgctggagatgagagagggtgggcattttggagagagagtcaccagccttcaatgagctggctggagaaggctcagggctaaggtcagggtcatgggccccaccctggtggggccccaggattctgtcttatgcttagggctagatgatatatctggcgtctattcaaaaggggtccctgccagggcctgaccttctgacacccctttcccctccagagcagcccagccttctccttttgcccgggtcccacccacctgcccttgccatgtgacctttgaggccttccccaggttgagtctttgcagccagggctcccacattcctggctatgctggtgttggccagcagccctagttcctttgggaaagagcggacaggaggctcccatggcggggactgtatcctttccttccctcccttgccccaggggctgcactgggattagggtatcttcctccctggccatatcaccacagtcccacctccagtcacagtctcccctcccctccctctccctccctctctccatcctcctcctgtttctctggcctcatgaagagccccatcatcccccagctgcccaccatggagtgggtggttggtagtgccagttaggtggcagtgcaggtgcctgagccagggtgaaggctggaaccatgttggtgaggatggaagggaccagctgaaagtatccaggcgatgaggccttttgacttttgaggggctccaggatgactacaggtttctggcatggggggtctcttttgctgagacaaggacagaggggtacaccagtctggagggaagccacactgaattggaggtgccttcaggtaccccgggggagaaggctgtctggagggcagcaggatatgcacactgttaaggtgtcccatttgttggctgcccctttgaagctgggggcagggcagggggccagagcatactgtagtgcaaggtcagaggcccaccctaccccactgctgtccagggctcctgttagagccacagggaagtcgctgactggctgtccttgtgacccctcctcccagatagctgatgaaggcacttggtcagaaggcacggctggctgaggccacagcccctctgctgccccgaggccatccttccctgttccacgggcctggcacttcccaggcggctgccgcaccactgaccacccttccagctttgggtccctcgtgggtttttcgtcctttcccccatccctagcctctcttctcaccatctccttcccagggaccctccctttctcctcccgcaaacctcattcttctccttttcccataatcaggaagagctttgattgcccattatacctggagcccaaattgtcagcaggagagaaacgggtttcccccaccttgagggcctgaccttagacactcaagtgtgccagccagggcagcattcctgggaagagaggggagacgtctaggttccaaccagacgagagtcaccctccccagaagaatgggccaaatgactcctaatacaagggaaaatagagacaaccccccaaaaaaagttttacaacaaaaccagctgaatgttcaaaacctgccccatctcatttctttgaaattggagagaatttaactcatcagcaaaaataaaggcaatgggaatgaagagatctccaaaggagtttgtaggccgggcacagtggctcacgcctgtaatcccagcactatgggaggccgaggcagttgaatcatttgaggtcaggagtttgagaccagcctggccaacatggtgaaagcctatctctactaaaaatacaaaaattagccagggatggtggtgcacacctgtaatcccagctactcaggaggctgaggcaggagaatcgcttgaacctgggaggcggaggttgcggtgagctgagatctttgcattgcaccctagcctgggcaacagagtgagactctgtctcaaaaaacaaacaaacaagcaaaggagtttgtgtggtgtaagaagaaaactggggacatttaaggcgaaaactaaggaaaatgattcagtgaaggagatcagaaagatgtggtcagaggagctggaggaggggggtggaagaggaggggagagagagagggagaaagatggcgggatggcggggggagacagagacacagagagagagagagagacaccagccaagataagagagcaagagagggaggagtttccaagagactcagagaagctataggtgaagagttggagttcacaacccagagggaaggtggtggtgccctcttcttggaccaagttgggtggaagcagggtggaggtgagggagtcatggagtggaggcagtgactgtggggagggggcaggaagaagtcgaaggcagctgaaggagaatgagtgagtccagggaagggtagggtgctgagctggaagagctgagatgtttctaggcaaaggggagggagccagagagaggaaagcaaggcccctagcaggcaggacccaggctggagggaagaggggcaggaggaggaggaggcggcagacaggctgggaggcagagtacctgcaggtgtggcgggggctgacggggtggcaggaagcagaaatgacctctgcttattggtctgaacgggaagtgaggttttctcctgagatctggagagaggatggaggaatatttagatgaggctgaggagaagtgaaggtttgaggacaggctagaccatagcctctgcggtggctgcaaggctctggtgactgccccttggccacagccccccagcagtttgagggtggggccaaaacgttgcctacaggggcctgtccagggctgtaagtgtggatctagggagggagagggaacctggtgggagtaaggattgctgctccccaaccagtttcctagggaaaaccaaatttagaatcaacagaaacatgactgggcttggtggctcatgcctgtaatcccagcactttgggaggctgaggcaagtggatcacttgaggccaggagttcaagaccagcctggccaacatggcaaaacctcgtctctaccaataaaatacaaaaaattagccaggcgtggtggcacgtgtctgtaatcccagctactcaggagttagaggcatgataattgcttgaacctgggaggcagaggttgcggtgagccgagatcgcaccactgcactccagcctgggtgacagagcaagagacagtcttgaaaaaacaaacaaacaaaaaaaatcaacagaaacctggcaggggcttcggaattgtaaaatgtgactatttgctttgtggcaatgtaaaaaaaaatcacattttcactggaaagaagaacaaaggaagaaaactgaatgtctgggaacaaattgatgctgacatttctctaccttgctggtgtccacctgcccacgtgcctggcttgtttatcgctgtgcttacaaatatttcctactctttacttcttgacatcttgaccaaggtaactgtgatgaggtaagacacagtctgttgtcattttccagcaagaactcacccaaggagttaagtgatggcccagagttttccagaatcactatcacctggcactacaatagaggcagagagcgaatgatactgtccaagacaggtgtctcttaccgtgtgaagataaatgctggttgatatcgcccattaggccgggtgtggtggctcacgcctgtaatcctagcactttgggaggccgaggcaggtggatcacctgagatcaggagtttgagacctgccttgccaacatggtgaaaccccgcctctactaaaaatacaaaaattagttgggcgtggtggtgcacacctgtagtcccagctactcaggaggctgaggcaggagaattgcttaacccgggaggcggaggttgcagtgagccgagattgcaccactgcacttcagcccaggagacagagcaagactccatctcaaaaaaaaattataggaaaagaaaccttttgatcaatgaagatgagtggtgatctttgcaaaagtgtacagattctaaatggaatgctggggaaaataaaaactgatacattacagggttttatatctgtcaatgtatccccagcttttaaaaaaggagtcattggaccctagtgttaggtccacagggattcaatatgttatggctccccttttgtgtggtgtgtgttcagaagtttccataattgaccagcctgtaatcccagcactttgggagactgaggcagaccgctcacttgaggtcaggagttcaagaccagcctggccaacatggtgaaaacctctctctatatatacatatacatacatatatatatgtaaaatatatattatatattatatatataatggttccgtaataaagtcttaaattttttcttaaagatggaacaattgacaatagacacctgtcattcttctttttcccttcttattttggaagctctgctagatgctgctgtccgcaagtactgaccttgccttttctgattttcattaaaaagaaactcatagcaacaaggtaccagttaattcctctcaccagagagctcttctccctgtttctcctccctcaggcaataggagatatgtaaaatgccttttcaggctccctttcccctcctcaatgcctaactttgccatcattcagcactttccctttagggaaattcttattgcatctctcttctgtttaaaaaaatatacttatttagcccttacattacaaattccatcctatcattatttattcggaggtaattgtacatgatttggtcagctcacggctcaccacaggttcctcttttcttcatctccttgtctccaatctgattcatctatttcctgattagattcctttctatggtatttcccccatatgggaaaattatgtggacctttgcatttcttctatcctaggaaggtgaatggcaacctggttggtttaggaggcttttctctgagtggtctgtggaggtgattcatattggtttctagcttgcaaataagatgtacgatttcagtctgattctcttctttctatgcaacttattttctcattagggaagcttgtctgaattttctctttaatcgtggaattcaggaaccttaccaggctatgcctagatgtgtgtcttttttccatcattcctgcctggaactcaatgagccttttaatctgcaaacccaagacgttcttcaaaccacggaaaattttctttctcatttaaaaatgattgcttctcttctatttcttcttttttctgagatttttattcttattttcatcattcacctattacaactcctggatctctctcctctgaggcgcttttagatttttactttgggttttgcattatctcttccacatggtttcctctcctccaagtcattttaaattgaaaacgatgtttcttcgttcaggaaagtatttgatttcacctttgactattttattttatttttgagatggagtttcgctcttccacccaggttggagtgcagtggcgtgatctcggctcactgcaacctctgccttccggtttcaagcgattctcctgcctcagcctcctgagtagctgggattacaggcgcccgccaccaggcccggctactttttttatttttagtagagacggggtttcactatgttggccaggttggtctcgaactccttgtgatccgcccgccttggctgcccaatgcctttgattttttaaaatgtgagcttatggttttgtttgcttttcctgttatgcaagttgtggttggtctcctcttgcagtgctgagtgaattgcaggctcttccttcctggccgctggattcccttaggtgccaactgtctttctgccttcttgcagccctaatcatctccaaggctcagatccagctgacaaattggctgcacctctctgtatcccaggagagagcgctctgctcattctgctgctctgcatccccgtctcccagcctcggggcagggagggattctgcagggcctcccaggaccacccaaagctgctggctctgctctcctctgtgcatccctgcgccaagttctctctttggagccttggagatcccattctcacccagggctctctctgctgcgggtccctactgtctgccccagagggagactaagtcctaagccagagctatcaagacaaaggccctgtccaaccgaccaggcctggctgctggctgacccaggagctctgctgtgggagcccattggatattggaaaggagggcagcagggcggtcaggctgccttcaccctggaggtttaattaaagagaagttcttgggtttcatgatattgaagagatgactgggatcaatcaaaagtttacttatacttgcaaaagtatatcagaaaaaaataaaaagcaaaatggaatggatttgaataaaatcagttttttttaaaatttactaggtctatgatgatgtatctagcatgcatagaaaattgagtgacattgaaggagttctgaggaattccgcacatttttttgttgtggtaattatagcattttgtgaggaaaagaataaaccttggctgggtgcggtggctcacgcctgtaatcccagcactttgggaggccgaggcgggcggatcatctgaggtcaggagttcaagaccagcctcaacatggagaaaccccgtctctactaaaaatacaaaattagccgggtgtgatggtgcatgcctgtaattccagctacttgggaggctgaggcaggagaattgcttgaacctgggaggtggaggttgcggtgagccgagatcgcgccattgcattccagtctgggcaacaagagtgaaactccgtctcaaaaaacaaacaaacaaacaaacaaacaaaaaacaaaaaccttaaatgctctcagttctctccttggcacaacaccatgtacccaccaaaagagttttccaaacctttggacgtgggtgaagatgaagtgtgcagggaacagggtgatttctttttttttttttcctttgagacggagtcttgctctgtcacccaggctggagtgcagtggagcgatctcggctcactgcaacctccgcctcccaggttcacgccattcttccgcctcagcctccccagtagctgggactacaagcgcccgccaccatgcccagctaattttttatatttttagtagagacgggctttcaccgtgttagccagaatggtctcgatctcctgacctcgtgatccacccgcctcagccgcccacagtgctgggattagaggcgtgagccaccgcgcccggccaatttcttgaaaacacattggactgggcgtcacggtccatcttcagctgccgatgaagaactttcagataccattagaccacaggaagttgtaacaaatgactcttcagctcttgcaggtgagcgaagtatacaattgctatcactgattccaaatttgattttatcttttgttttactttcttttaaccacatgataagtgtcccaggatttttttctaaagagcttcaaagtgaaactgtagacattttctttgcctttaaaagccaaaaaagatcaccatctgagagaaattatgagcctttcaaggccacctgggacagagtggagaaatgatgccaaaaaccaattcctaaggacttcaaagttgaaaaatgtttccttcagaagaaaagaactgctgagataaaacaaatgatggcaattccaattatgcatttttcctactttctcataagaaaagtattaaattaatgtctcttatgaaggatgggttcctagattacatttaaagttacagtttcatagaaataatcatattgaagtgaagcaaatttctgagcagtcccattcagttgaaataaaataatacacagaaatagtcaaacacgtgcaaaatgtgtgcagcctggaagcactctgaatcccacaattcagagtgtgttttatgaaactccaaaaggatcacttctgctacgattgtatcaacttaattgatcttggcagcctgatgatttgacactgtcttcactaccctgctccttagtctcagcgattacaatagcagtgcagaaagctcattttctactcttagtgacttagaaacccgcttctgctgctctgtccagtgacaggctctggccccaacagctgcagagtgagacaaatcacatcgaatgtttcctgagtctttccttttccaccctgatacggtttcttcacccaaatctcatcttgaattgtagctcccgggagggatgggattgggagggactgggtaggagacaactgaaacatgggggtgggttcccccatactgttcttgtggtagtgaataagtctcacgagacctgatagttttttgtttttttgagacagagtacactctattgcccaggctggagtgcaatggcgcaatcttggctcactacaatctctgcctcccaggttcaagcgattcttgggcctcagcttcccgagtagctggaaccataggcacgcaccaccatgcctggctaatttttgtgtttttaatagagatggggtgtcaccatgttggccaggctagtcttgaactcctggcctcgtgatctgcccgcctcggcctcccaaagtgctgagattacaggcatgagccactgcgcccagccaagatctgatggttttacaaggggaaacccctttctcttggttctcattctctctcttgcttgccaccatataagacatgccttttgccttctgccatgattatgaggcctccccagccacgtggaactgtgagtccattaaatctctttttcttattacctagtctcaggtatccctttgccagcagtgtgaaaagggactaatacacaccctgaattcattagttcattcagtcttcaagcaaccctgcaggaagaaatcactagtcccatttgctgtaggaggaaagtgggggtcagagatgttaagtgacctgcccaaggttgcaaagcaagtaagagtcaaacctagcctgattcccaagccggtgtaatcactgtgttcagtttgcagccaaagggatgaagatctgaggctcctgtgatatcatggatcatctatatttgctgagataaaaatgatgtgctactaatttaatctcatctgtaagaacttttctttcccagagttatgatgtcttttatcaggatggttagacatccacgtatggttccgaagctcctgctgaatagggcgggccatggaatgtctggtttgttgctgggatggcataaagggcatacactgaagtgaaatgctgacaaaccattcctctgttcttaaaaaaataaaaaatgtgcctggctaaacaaactgtggaatattaatataatggaatactactcagcgataaaaaggaacaaggtactgattcttgtagcaacatggatgaatcccaacagtcttacactgggcaaaataaaaagcctgacacaaaagggcacagagcaaatgactttatatgaaattctagaaaagacaaacttagtgtattattgtgctagggctaccatgacaaagtaccaaagacggggtggcttaaacagcagaaatttgtttcctcacagttctggaggccagaagcctctatcaaggtgttggcaggggtggtttcttcgtaggcccctctccttggcttgtaaatggtagttttctcccagtgtttccacgtggttgtccctctgtgtgtatctgtgtcctaatttcctcttcttataaagacaccaggcatattggattaggttccaccctaaggatctcattttaaggtaatcacctctttaaagacccaacctccaaatacagtcacattttgcagtactagggattaggactttaacatatggattttggaagaacacaattagcccacaacacctagactatggtgaaaataagcagaatagtggttgcctctgggaggagtgtgggttagggatatactaggaagtggtttgggagactttctggggttgatggaaaattggatttggtgatagggtttgggttataaaagttatctacatttgttgcccgggcgcgatggctcatgcctgtaatcccagccctctgggaggccgaggtgggtggatcacgaggtcaagagactgagaccatcctggccaacatggtgaaaccctgtctctactaaaaatacaaaaattagctgggcatggtggcacacacctgtagtcccagctactcggcaggctgaggcaggagaattgcttgaacccaggaaacagaggttgcagtgacctgagattgcaccactgcactccagcctggcgacagagcaagactccgtctcataaaaaaaaaaaagaagtatctacatttgtcaaactcactggaataaaacatgtagtccacatggtacatggaatagtacaatttatgcatttaattgtctgttaattttgcctcaaagaaaaccagaaacaaatattgaactctagttaataatatgcatgcctactgttaagggataaagtgtactgctgtctgcaaatagcttttgaattgatggctgggtctacagatggatagatatttgaaaatgcacatatagcaatctaccaacaattgcagaatttagatggtggattccctgtacaattattattattattattattattattatcattattattattattattattgagatggagtcttgctctgtcgcccaggctggagtgcagtggcgtgatctaggctcactacagcctctgcctcccaggttcaagggattcttctgcctcaggctcctgagtagctagaattacaggttcccaccaccatgcccggctaatttttgaatttttttagtagagacggggttttgccatgctggccaggctggtctcaaactcctggcctcaagtgatccacctgcctcggcctcccaaagtgttgggattacaggcttgagccactgcgcccagccctttcttttcttttctttctttttctttttcttttctctttttttttttttaagacagggtcttgctgtgttgcccagactggggggtagtgttgtgatctcagctcactgcaacctccatctcctgggctcaagcgatcctcccacctcagcctcaagaataactgggactataggcgtgtgccaccacacccagctcatttttgtattgttttataagagttgggtctcaccatgttgcagaggctggtcttgaactcctggactcaagcgatcggcctgcctcagcctcccaaagtgctgggattacaggcatgagccactgtgcctggcctcattgtataattctttcaacttttctgtatgtttgaaatttttcatcataaagtgttggggggggggataaaatttccatttgaaaatattagctagacatttctcataaaatctttcttcattgctagatcaaggttgccacgagactatgccaagtcaattgtccttgtgtcccccaccaatatgcccaggaagaaagagtagggagacaattccgaaagaggccttgagggtgctagggagttctagggactagctaaggcgtttgggctctgtgtttgaggaaactgaggctcaggctgttttgcgttgctgtttagaatccagggaagtccaggatgttttttcttaagccatgttggggtgcttaggctcagtggagaagcggggcatggccatatgaatgatatgcagttggcagcacatagtaggcacacaagtgtttgctgaatgaatatttacatgaaattggaaaggagccttccaaagatggagccagcaggagacagtgaagttgcctgtgcgggccgggggagtctgtctctgtctctgccccagcccacctctggcctggcctgagtaccttgagaagtgggcccaggagaggcccctggatccctgggttcctggacagccagggtgagggcgctttgccacattcttaggagagagcacatccaaaacaatttctttttctaaaaactcagtgctaacggattccagatgtccgtttgttatataatggggtttgttttaatagcgtcaacttccagatgtgcagcctggaatcaagaagcccattggccccctgaggacactgtgagccaagctgagagctgcccgggggagagacatggacgtgcagaaccagggatgggagaggagccagggtgccttcttgctgcccactgggctgctcacctgccctgcagctgtccccagactgaaagacaggaagggtgttcccgcttccttttttttcagtcctgactctgagcaggggctcccaggggacaatcatagacaggcagcttggggagggtctgctttggaatctggttcaagcaggcctagctggatgagcctggagaagtccttggcctccctgtctttgaatggaaaatagaataacgccattctacccagagaggtcattgtgcaaaatgaaatgaagtaagcagcacagcacggggctcagaaagccttgactttccctgagtggagagaacaggggcccaagtcaccgagcatcctcccctactcctctcagcaacacggatgcccctgggcagcacgggctgcattttccctggaacactggaaaagagccaaggtggggagctcaccacctcccccagtggcttgttccatggccctgcagctccaacggatagaacattcttccgttcactgagccaaaggcggcctctgtgtgacccccaactggtctgagttctgctctctggagctctgctgagcaggccacaccctctttcacctgataccctcgagtatgggaagacagagaccgagtctcccaacccttttcctagtaggcagctgcagttatgacatcagatggacgaagattaagatgctctaaggagagatgttcaaaatcccaaacaagaaaagtctcaacgtctgggggaatgattctgtggttctccctgtgtagatgttaataaaatctgtatgccttcactccaattcaaagagaaaagggccaggctcacgcctgtaatccccacaatgggaggccgaggaggatcacttgagcccaggagtttgagatcagcctgagcaacatagagagacctgtctctactaaaaataaaaaaattaaccaggggtggtggcatgtgtctgtggtcccagctaattgggaggctgaggtggcaggatcacttcagctcgggaggtcgaggctgcagtaagccatgattgtgccactgcactccaccctggatgaaagagcaagaccttgtctcaaaaggaaaaaaagaaaagtcacaaaatctgaatgcagtcacaggggtgaggtgtccacaaagagataaagtcatcatcttctccaaatgaatctatacacacaatgcccttccaacaaatttccaatcaaattggtgggggtagggagagggtgcaatataaagttgaacgttaagtgtagaatactcaccatgtctccgcagatgaaaaacattaaagcgggacttaccctctcagctgttaaaacacaggtaacactaaaatacattgaacattatggtacttgtgccggcgcagcagagagggaaatggcacagaaaatggaaacacgagcagtagacccatctccatatgagaatgtggaatgtggcaaagaaatgcatgtcacactaaagcaaataggaaatttcaacagtggttacctttggggagagggacttggcgtgggacagtagtgagtgagagggaagtgttcacttttcattttgtatcttttagagttgttttattttccaaccttatatatttttgtttgtttgtttgtttttgtttttgagacagagtcttgctttgttgcccaggctggagtgcagtggtgcaatcttggctcactgcaacctctgcctcctgggttcaagcgattctcctgcctcagcctccttagtagctgggactacaggcgcacaccaccatgcctggctaattttttgtatttttagtagagacggggtttcaccgtgttagccaggttggtctcgatctcatgaccttgtgatccgcctgcctcggcctcccaaagtgctgggattacaggtgtgagccacgtgccctgccatatgtattcttttttttaaaaaaagccaacatatatatatacctatatatacacacacgtatacatatatacacacatatacatatatatgcatatatatatatatatatattttttttttttttttttttttttttgagacagggtctcactctgttgcccaggctggagtgcagtggcgtgatctcagttcactgcaacctccttcacctgagaagccaacatgtttttatgccaaaatatgttccagaggttttgatcccttttgggttttctcttttgaatatttctgcacttaagagaaacctagtaagtgttataacacgaataataataggatctataacaaatgatgaacagttattgcctctacctcagggaggtaaaaggggagggcttttacttccttagccatacatttccacacttctcatccccctcctgctcgttcctcttcttttttctggatagcatgtataactttaaaaatcgaggagaggggggaattgaaaatttgaaaaaaaaaaaaaaaacagggcagaaatgatggattacttaagatgtgggactggacaactggctaacaatttggaaaaaagttagatttctaccttaaatctaaatatactgcagatggcttaaagatttaaatgctagaaggtaaaccataaaagaatccgaatacttacacaattttaggataggggacaacttcctaagaagacatcatatgaacagactgatagatttcatgacataataatgggaggcttctttctaacaaaacataataaaataaggtcaaactgtgaaaaaaaagacaaacaatatttaacagaggatcaagcattttaatatagaaaaagctcttacaagaattcctgcctcataattgttttccctaagccaagaatgggggggaatttgaccacagtgaaatcagggtttctaagggcaggaggaaggtaggaggggaggggctgaacggagttttcaggatgggggtggacagctcagggggacagctccagggccagggttgggtgacctccatgtggcaggggttccccactctccctggcattcacagtcttatctggtgccagtcacttccccagccagcctgacctccctgcctgggacatttaacattttgccatcttcctcacacatcaggcatttccctgtttccatgacttttgcaaatgctggtccttctgcttggctcactctctttcatctctacctgaaaaaaaatccaactgctccttcaaggctcagctcaaatatcccctgttctgcaaaactgtctttaatccatctgcccccactgcccccaaggaactccccttgggctcctatggcaactgcccatcagtctattcagcacttactatacagcattgtcattttctgctcactggctcactctagacagggagctccagggacccctttccccttctccaggtccggcaaagagcaagtgctcaattaatatttcatgaacaaatgcatcgtactgtgagtgacagagcagggcaactgaactgacactagttgagcttcaggttcagtccatttcttttatattttttgagacagggtcttgctcagtcactcagactggagtgcagtggcatgatcatggctcactacagccttgaactcccgggctcaagcaatcttatcacctcagccccctaagtagctgagactacaggtatgtgccattgtgcccggctaattttttattttttgtagagatggggccttgctatgttattaaggctggtctcaagctcctggcctcaagaggtcctcctgcctgagcctcccaaagtgctgggattataggcatgagccattgtgcatgactgatttatttcctaaaacagcatgcttttatttaaaataagggcaagttatttaactatgatgcaattaagagaaataattatgtataattcaattatgatgcaataatttatcataactgcatcatagttaaaagatgccaagttactgtaagatcagaagacctacgctaaggcacagtggtacgtgaatgcacttgaactattgaaagccgctgtcagactccacaatggctttcatttttatttatttatttatttatttatttattttatttattttttatttttatttttgagacagagtctcgctctgtcgctcaggctggatggagtgcagtggcgcgatctcgactcactgcaagctccgcctcccgggttcacgccattctcctacctcagcctcccgagtagctgggactacaggcgcccgccaccacgcccggctaattttttgtatttttagtagaaacggggttttaccgtgttagccaggatggcctcaatctcctgacctcgtgatccgcccgcctcagcctcccaaagtgctgggattacaggcgtgagccaccgcgcccggcccatttttaaaacatttataaacaaaagaggtttaattgactcatagttctgcatgactgagcaggccttagaatcatggtggaaggcaaggagaagcaaggcacatcttacatgagggcaggaggtggcggggcagagagagagagcgcgcctcaatggctttcaatagttcaagtgcattcacaccaggcgcattcctgcgcttgagattcctagcatcagccaggagcggcttagtgggagaaagagctgcgacggtgatgatagtgacattccaaagttttgtggcaacatgaaggaggaggtgtgtctgcgcttgcacagtgactgcagcccttgggcagatgtggagaatgtgtgaggctaaaggctcccacgcagcatggggcatggggagcctgaatgtaagccccagggcaggaagttttgcctatttgctcaccgtgtaatctccagcatctagaatagcatagtaggcctttggtaaatatctgttgaatggaaggactaaaattagttctggaagtgtctggggatggggcttaagttacctctgcagggtctccaaggctaaatccttttcctgagttagaaaaacagggctgttctcactgaagttttggccttcagagtgtgatgaggagtgcaaaggggcacggggcagcttcaaggacagggctgggaccacagagggtgagaaaagggcacaagggaggaggggtgctcccaagatggcagcccctagagatctgggctgggtcttgctttcctccctggggccagtgcagcaggagagggtgctgggtaggggtgctgggggctgagaggaccaacccagcttcaccaggcccagaagagaagatgcacacagggagaaggcagctgtatgcagtgggctcaataaagaggatttgggctgggcgtggtgagtcatgcctataatctcagtgctttgggaggccaagtggggaggatggcttgaggccaggaattccagaccaacctgggcaacacagcaagaccccatctctatgatacatttaaaaaaaaattagccaggtgagtggtgcacacctgtagttctagttacttgggaggctcaggtgaggggatcagttgagcccaggagttcaaggttggttacggcaagcactccagcctgggtgatggaatgagaaatgaaaccctgtctctaaataaataaataaataaaaagatttgcctctgtataacaggagtttgaatttagggctcaaaaagtcaagtacattctcaaaatcactcagagagtgacaaaatcaggattcaatttcacatctttctaattccagagcctgactttttttcactccgctaaaaaaagtgacgtcacaggcacatggcaggcatggagccccaggcgagccaggtctcagtctgggtcagtgtagccccagggctgggatcagaaccacagtcgttctggagacagggccaaactagggttagaggtcagggaggccaggcctgagaacaacaggctttccgggctttgtgcccccagccagacacagtgtcctgggattggtggcagggcctgctggagcccccagctccctctttccaccccccatctagggcctggcctgaccttcctccccagggcaaggaactggcctggctcttatcctggaggaggctgcagctgctcctgcagccctggtcccagcagacaaaggcgctttctttcctagtacaaggtcttgattgcatgttgccctggatccaaaagttcctatggaggaagcagtttcctcccagggtgtgtgtgtgtgtgtgtgtgtgtgtgtgcacgcacgtgtgtgctgggtttcagggagttgggctgtcagggagtgcaagccctctcccagcctcctgggtttagcctggcattgctcaatctgcatcctttgtgtacatctctaagtgtctatgcatgtgtgtgtacgtggtggtgtgtgattgtatgtatgagcatgtttgtgcatgtccctgcagctgcaggtgcgactgcctagtatgtacctgtgcatatttctgtacacatcagcacatgcttatacacagtcgcaagcctacgtatctgtgtaacttgtgtctgtgcccacatgcgtttgggggtgtatgcatatgtttcatgtgtgtgtctacatgagacacctggtaccaggtccctaactctgctgcctctggctgtgcctccccacaccctctgctgctgtgtgggggctctgcagtatgcaagtcctcctaaaatagccccctttcttcttcccaacccccggccccgcctctgcatttgtctgggaacaacctggcctctttcagctctgggaggaagacaggtttgtacagcttggcttggcccatacactttccaaaactctctggctcccagccaaactctttataaaaaggctcatggggaatagcctaacaggaaggtgggaactctgcctggggggctcaggaaccctgctccaagccccaagattaaatgggagcatcagtcagctgaacttcagccagagacggccctgcagcctgaaggtgaacttggtcaatggacccttcacccccaaagatggggacacagcatctcaaggtctcatgtccagggtggcagagctcggaggggtcccagggctcaggcagctcaactccccatgggcacactggagggagaggcccagagtgatgccccagaccaggcaggagctgagccacttcctagcatcctgcagccccaggccctggtgaccctgccatggataaccctgggtctgcctcttctgcagggaggtgggtgccactgccagacttcagagtagcaggctctgagcctggctggcccttttgctcaaggcctcctgagtccatatcacaaagtcagtgtttgagcacagggttggtttacccagcacttgccttacttggggtgcaggggacctcaagctgtttctcctagtcccactgaggcacaagagaggggctttctgtactgctatctcccctactggggctcaacccagtcttttttttttctttgagactgagtctcactctattgcccaggctggagtgcagtggtgcaatcttggctcactggaacctccgcctcccgcgttcaagtgattctcctgcctcagcctcctgagtagctgggattacaggcacgcaccaccatgcctggctaatttttgtatttttagtggagacggggtttcaccatgttggccaggctggtcccgaactcctaatctcaagcgatccacccaactcggcctcccaaagtgttggaatcacaggtgtgtgccaccgtacctggcctccactgggtcttaagggtgccctagggtgaagatgggagggcagtccaatgggtaagaccctatctcaagtggatgctcagggcacaggtggcacccccctcactggtctgtcacaggagacacaggggctgctgctggagatgccacagccgtgtgggaggggcaggctggtggggcaactgaggaagaggatcccagaagcctgggttcagacatggctccagggggctcctgggtgctggaaacagacgagacaccctcaaagaggctggttccttcagtccatccccactgaccgctgccaaccacccctttcctcttcccttcagaaacctttttccaggcgggagggatggtagctgggaagctttgctcttatctggcatgtgcccaggccaggcaccgaaactcaaaagccaagcagagaatctttttttgtctgcttccgattgtcgtaccttgtccctgagagacactcatggaccagcccagcttgaaaaggagccagagaacacaagaaacaaccagtaactccaaagaaaggtcagggtttcaagaacattgtgcccccccggttgactgtgcagagcaagtacctctttggatggaggttttatttctttgaactcttgttccttacagaggctgggagtggttgggcccacagggtgggggtggtggactccttgtccttgggcctgttttggggatgctgggttgcgcactgggagtggagttggtgggggctctgaattctcccacgctcagtctagggatgggagctgcctctttcttccctcatgggatgctaattatcctcaacttgtctgggagaagaaaggaagtagctgcaggggcttagccaggaggaacacctgctcccctgccccaccgccctccagctctccctccctccctccttccctctctctcagatgcacaccaacactaggagtatccttatatacgtatgtgctgcttcttgacggggaaatttgacaagggactggggtgagggtaggggtgtcttctacctggggaggcccaaggggctgcggctggggctttcctcagcctcatacaatccaccgccccgcccccaacccctgcccaaggcactcacggtgccttgtgcctccgggctctttgccggtctggaaagtctgggatctgtgaatggaaaagcctgggtcagagctggagtggggagtgggtgggggttgggagctgtgtctacagagtttagagttttcttggtctgagccaggaaagagtctaaacacccagcagtgctgagtccttgcctgccctgtgcagcgtggaccttcctcggcccagctctcctgccctatgcaggctttgggagtccctgaggattttcaaagagccccaaggcgctggggacagagaaaggtgaggccaggttgtcatcctgagggggaacaggcacacacagccagcaggggcctgatggtagatgagaccagggtgacgtggcaaagctgcttcagtctggccacagcactgcatcgacctggactcttgagcctctcctagtgtcctgcttctgagagccagctggacatctcagtggggaacaggacagtcactctcgaggcaggaggatcgcttgagcccaggagttcgaggctacagtgagctgtgatcacaccactgcactccagcctgggtgacagagggagattttgtctcaaaaaaacaaaaacaaaaacagacaaacaaaaaagactcagtgtgaagaggggagggggacagggcaactccagtgtttcctccaaagtgaaagtatgccctcgggtttggaggctggccctcaagaagcatgcccaaagccaagggcttcttggaagcattttatctcaaaagtagacatgaatcttatattccactatgtgattcatttttatacaaaaccatgttggagttaatatgaaatatatatatatatatatatatatgtatgtgtgtgtgtgtattttttgagatggagtctcactctgttgcccaggctggagtgcaatggttccatctcggctcactgcaacctctgcctcctgggttcaagcaattctcctgcttcagccttcccagtagctgggatgacaggctcctgccaccacacctggctaatttttgtatttttagtagagatgggcttttgccatgttggccaggctagtctcgaactcctcacctcagatgatccgcccgccttggcctcccaaagtgctgggattacaggcatgagccactgtgcctggccatatgaaatattttaaatgagtttttgcattgaatctatgaataaaattgatgctgcaggatggggatcgacaaactttttctgcaaaggatcagacagtataataaatattttcgactttgcaggctgtgtggtctctgtgaccactgctgtcgtagcccaaaagcagctttgtatagacaatacacaaaggaatgagtatagctgtgtttaataaaactttatttatggccactagaatttggatttgggatcttttttttttttttttttttggagacagagtctcgctctgtcacccaggctggagtagagtggcgcgatctcagctcactgcaagctctgcctcctgggttcacaacattctcctgcttcagcctcccgagtagctgggactacaggcgcccgccaccacacccggctaattttttgtatttttagtagagatggggtttcaccgtgttagccaggatggtctcgatctcctgacctcgtgatctgcctgtcttggcctcccaaagtgctgggattacaggtgtgaggggattatttttatgttcatgaaatatttccctttgattgtccaattatttataaatgtgagtcctggttcttggcttgtgggccgtagctctcactccaccctgggaagaaagcgtgttgggcctgtggctccacatgcaaagccaaggcctgagcaagaacactagattctggaatcagacccatctctaaattcttgttcttcctcattagttatgccactgaaggcaggtgacaacctacctgagcctggtcctctcctggagaacgtgttttggaatgagctcacagaaggcctgcacagtaggtattgactaagcagtgctgtggccacctttagtggtgcatgtagctgagctgcctgggtaggaggaaggtcatggccagcagatgagtgggtgagatgtgcctcttccccctccctagtcagctcccccatccttttccccaggtcattctagctgaacagttgtcctactccctgccatccttctttccaccttccaagattggacactgcttctcatggggctccttggccctgggctggtgagtccaagcacttagacacttactccctaggataagccccagctcagaggcctcccaacaccagcactgcgggatgggagggaaaaactgaggctaactgcctccccactggcctcagggatggtagctgcagtgcaagggccagagcagcctctctccccttgctcatcatttgtgcttagtgctattttatgaagctgcactctagagggatggcctgctccaagcctcagactaaagatgcccagctcccctcctggtcagtttacagttctgggtttactccttctgagttcccgaagcccagccctgacattttccagctggatgattgggcaagttacttagcctctttgggcctgggcctgtttccttgtatgtatgaggataacctcatagggttattgcggggattaagaatttggccataacatatgtagaacaaatcctactcacaggaagtgcctagtaaatagcacactattgctactaagtaaggttaccagataaaatacaggctgtctggttaaatttgagttccagataaacaacagattttttaggctgggggtggtggctcacgtctgtaatcccagcgctgtgggaggctgaggtgagaggattgcttgaggccaggagtttgagaccagctagggcaacatatcaagatcccatctctacaaaagataaaaaattagctgggcatggtggctcatgcctgtggtcccagctacttcagaggctgaggagggggcgtcgcttaagcctgggagttttgaggttgcattttttttttagagacagggtctggctctgctggccaggctggagtgtagtgttgtgatcacagcttcctgcagcctcaacctcctgggctcaagtgatcctcccacctcagcctcctgagtagctgggaccacatgcacacaccatcatgcctggctaatttttcaaaatattttttgtacagatgaggcctctgtatgttgcccaggctcaaactcctggattcaagtgatcctcccccttcagccttccaaagtgctggaattacatggtgagccaccacacccagccaaaaatatttaaataaatttaaaaagggaaaatttttaaaagtgcatataccaaatactgtatgagatatacttactctaaaaaatgtctacatgaaattaaaatttaactgggcgttaactttccctcctaaatctggcactcctacactgagggaggctccacaaacccaggaactttcctgttccccagccccaaaacagcccccacatccctctagtccacccagcacaatgcgctcatgcagaaaaaccttctttcctgcgggcaggacagaaagctggtttcccacagtgctctgagaccaatcccagatccactctgtacttgccttgggacttggaacaagctcttccttgccccttccttatcctgtttttccagtgagactggtaaatcctcttgctggctatccagaaggagtaaaagacctatgattcaacagaatcagcagtattaagaatctaattgattgggccagtggctcacacctgtaatcccagcactttgggaggccgaggcgggcggatcacctgaggttgggggtttgagaccagcctgaccaacatggagaaaccccatctctactaaaaatacaaaattagccaggcgtggtggtgggcgcgtgtaatcccagctactcaggaggctgaggcaggaaaatcgcttgaacccaggaggtggaggttgcagtgagctgagattgcaccattgcactccagcctgggcaacaagagcgaaactccatctcaaaaaaataaaaataaacaaagactctgattaatcatttcaatgaaccccatcaacagccctattagtgcaaactatcattatccccattttacagatgaggaaacagacttggagaagggtgttccaagtggctgttcctcccctgcaactggccctcattctaggtcttcccattgtcctccaaggcttgggctgagccagaactcaaaccccaaggccatctaggaggcaccaacttgtcacagccatgctcagactccatgtccaaattaacctcatcagcttcccagaaggagccagcgttgaactcacccttttccctattccctattttgtcccatagataccttgctgagtttggattatgaaagtggccacaatgcccaccactaggcagccaagatctaaattactgggctgggtgaaccctacttctgacctaataaataaatcctgtggtttccagaagaggtaaatgaacaatacttcttacaagaggccatttaaggaatctggtgtaaatgaatctagcatcaagttttccagagggtgtgacacttatttgagtgttctgtttttcctggtgccaatttttccgagtgtaatttcttcacttttggtttctgagatagaggccccagaatgttatcacgaaaggcaaaattggggtgctgtctccccagctggtgggactgcggggtctagcccagctctgctgttcatgattgacaagatagctttggcagcctctctgctggctttcaggaggcaaattcgatgttggcatccctctacccagtgcccaagatgctgtgaggacaaatgaggtcactaatggcaaacacacaccaacagtagtccagtgtgctgaaccaactattcctattctgcccttgtacaaggtagtatttcctgggacagtgttttaggtaaaaaatgaaaccaagaccctttactacttattgtttaagttattatgagggctccctatatcttgattagaggcctataaaacctaaggccttcctgtaacaatgcccatccatgcttcaggccattcatgcacccatctgatggtgcttagttgggacccaacaagatgaggctgcgtcagtctcttgctcagccttcaaagaggctttggcactttcctgccagcctcattggtaacttctgacccaccccttttggggttgagacaccatgctcaggagcacagagttctgaaaaaccttgagaatttcagctaccctggtgatcctgtgttttatgagcctactctaacctatgcaaatctagttcccccatacattccaggtgtgtgattgaggtgggactcttggtacggagcttaagaagtggcactggggatgtaccagctgagagcgttcaggcctccagtctgtggagcaggatgctgtgctgccaattcctttttttttttttttttgagatggagtctcgctctgtcgcccaggctggagtgcagtggcatgatctcggctcactgcaatctctgcctcccaggtttaagcgtttctcctgcctcagcttcctgagtagctgggattacaggcgtctgccaccacgcccagctaatttttgtatttttagtagagacggggtttcaccatgtcggccaggcaggtctcgaactcctgacctcaagtgatctgcctgcctcagcctcccaaagtgctgggattataggcatgagtcacctcgcccagccccaactcccttctagggcatgttttaaccacgtgttctggtcagttggtcaagagacaggccaagtcaaccctcatgatgaatattcgacaagccctcagtagggtgcccagcacggatcagacacctcggaaaggcgatgggcataccatgtactcatcaatgccccaggcagcaggagacacccaagtgccactgaattcctcaaatacaaatgtgacttttaaactttttcttttgtttttaaatccaggatcaagaccacaatttattatgtaagacatggggtgaagaatggtcaaggaaagttatggccgtgagtgacatggaattagatgaaaaggctcaagtttgctgaagagagtttaaatttggcttttgctcttggaaacgtcaaaataatcataagaagcacttgtgccttacagagcaaataatccacagagtgtcatattcattttgcaaacagggtcacaacagcagtcaaatagaagcctgaacacccagagagttaacatacagattccataaggataacaagggattgagcatgctggtgggtttttaagtcagatccacattgaaccctgtgacctaccggaggttataagtggaacccggggaaagcagcttttccatacaaaacaacaacaacacaacgacaacaaagaaaaccagactctgctggatgtctataatactcatttgcagtaaggctttcaagatacaggaatttttatagcatttgtattttaaggatttagggcaaatacatttttttttctacttgataaaaagaaaattagtacttaaaaggttcaaaaatatattgattgagttatttttcttacataaataaattatattgatttttaggatttaacagctgaaaaaaccctttctgcttccactggaggcaaaactgaacaaaatgttagttaaatagagagagcagcatttctaagaaatctgtggtcagcattatagaccatctatgctacaaggatgtcattaaataggatttgttcaattactggattcttcttctatgatcagttatagaatttctggtttatatctctgattcataaaactgggactccactttttgaagatacatctgattgatttttttcagtcatgatttaacagacttctttgagatgctcattttaacatttacataatttataatcccaaatgtataaaagacaatgaaaaaagcatcataaataaataatgcaaaatgaaatagttatgtcagacttttggaccttctgataaattagcaaaactgtaacagaaaaagtaaaaaatacagtaaattgtgacaacaaaaagtgaaactggtactagtaacacttgcaacatttccaagggtcctgcgcagccctgcgcccccagagtactgaaccatgagcttacttcaagtctcagagtgtgaactacctgtgaagagtgagaccatcagaagggacgttaacatgaaggtgaaaggacatggggaagtgctgcttaggcagtttctttctcagttcctaaacatggagaagctgaggaagaagagaaaataatgttgacttgcaatgtagtttcgattaactgataatttggaatttgggtccaactgtaagatataaacagaatggagaaattaatggagaagtaacttttcatagctgtattataaagggtggcacacatttgacagcctcagacactcttgatcaaaggacctactagcaagtgtcaaagtgttgggcaactgtcttcttgcaggctccagaaagaaccttattcttggtgaaggaaagcctgaagtgaaaatccattcggtcctggtgctctttaaacacagagaggcaaattaatggctagagaaatctgtaagcgaaccaggtgagagcagagcgctagccgtgtgcttgtgaagcagcgtgtagctctacggagcgcgggtccttgccccacccccgtcgacagcaataactcatggtgggtaaagctttctcgcagcaagaggaatcttttcactggtgagagggatgtatagaaaataatgcctagtcagtcagtatttcttcttgctgcaggtgtctgaaaaaccaccaagggggaaattatattactaccggtaaggtttttgttttttataaagaaatgaatatatgtattttcaaccattagttatatacttctgtctatactactcacttagtaatcatgataaaatagggaaatattttaactcaaaaatatgcaccagcacttcctttttctgtgctttttggttccctgtgacattcttcctgtgcaacccagctcacagaaaaagagctcctctttgtctctgttcttccacccttcaatggtaaaaccctagacagctttcttttgccatttttcctcctcaagtgagtgggaaacttggaagagaagggggtagggcgtgtcaccaagtactgtattaactatgattgctggaatgaactggataacagaatgagaattctgtgcctcctagactaggtagacaacacttatctaatgaagtggtgagaccctgcaactattaacatctgttaccatagttctcagacaggaaatcaggtacgtaatcttacttatggaaacacaggttcttatggaggtgaagtgagggaagtaacaaacctttatgggataagaaacttacaagtcacaataatttcttaaatgaaaaaagttctaattggtgtcgttgttggagtctttgagtgccccctccccagcctgtgccccatgttctctctctgcgggcaaaggggcactgggttcggcacagttctcatcaccgctgggctccctttcacagctgggagcaggctctgggtgggagttggggttgtccccctttgtcttcttcttcttcctcttctggctctccagacctactatttccgagtgtctggcctgctgcatggctggcagagccatgcccataccaggggagaggaacatggatgggtaaatgagtccaggagatactcctgggatgagaaatgggttaaaagccacaggactactagtagttattgcaggttcagactgatcagaaaatggacctggaccaggcttgtcctcagctaaagtgtctgttttcacatcatggctactcggcttgtcttccgcagtcttttcagtcactgccgtaccacttttcgttgtgcttgatagagacgccggagcagtggaagtgcaggtggttgccatgggtggactgaggagtcccccaacaccaaacatctggggcacagcagccatgcctggcagcatcatgggcagcatgctcagggtacttttgacctcttcacctgttggcatcgtggcaaagccagctggaaaccccaccagcccggtgagggggatgcctggcatatttctcatgttctgaagtcctaccaggtccatcccagcaatcagtccattcatgaacagtggccccattccagagggagagtctgccacaatggaaggagccttcaggagttcgctccgaggccgcctccccctcctgcgggggcccgtatctcgaagaataggctcagccagagtgtgattgaacttgttttctggaagaaacccctggaaaaacaaagaaacacaaaatgctgaaggcaacaggatggcaggtggtcagctgagggtgatgaccagggctctgcactggcctggcctgtctccagctgcacgaagggttcccagtacaaggagcacctcccgcctacttgtgcagctctctggcctgactgtacctgacaggcttctccctcagcagctgagaacattttgtggcatgggcacaactagggcacctgtcactgcccagtggtaattccaacatgctgactggcaaaagtggcatccagtctgtgagaagctggcagaagagagtggggagctggagaaagcactaaaagtgctctggttctcggtgagactgttatggctgagaccccttcaccagatcccaacacttgccttcctcttgacacaggtttttattgaagcaacaaagcagaatatgtaagacagggttttaatcccaagtttaaatcctgactgcaacctcctagctgtgggactcaggacatgtcagttagcctctgagtttaagtaaaaaaggacaatggtacctatctttagagtcacggaaagtgacgtgtttaatacattacctgatccataggaagcagtgcttgctaatggcacattacttatttattgtgtgtatgccccactcctctctgaatacaatgggatgtgtacatgtttgctgaagaaatgaaggacttcttgaacactgttggggaaactgccaccaaaataagtggtggttctccctaagggagaccatctattttttctctatttggaggttcactctccaattttcttaattagcagagagttctgcagtaaagcacttctgctccacgtggaccacactgtgacaggacctgggccctcaacacgggtgatctggcatctgcactggacattcccataacccatcaggatggctgagctgcacagaatcctgggggagggcagattgctccagcagcatcagcgagcggaaggcagcacgtggaaaggaaggcgcaggctgcagccccacaccctccttcctgagagtggagctcaggagctctgcagggcagagaggatgcagccaggaacctggtccctggagcgtaaacaaaccactgcaattacgatggatctttctctgaatttataatccctagagattgagagaatttcttcccacagatgggaagcgatttctttcaggacttagtgccgcagtccctgcgcccctggagaactgcatgcctttctctctctcgactgccctccacacctcactgctatcagctagtttatcaactagtacatgcccatggtattaaaaaaggtgaactgtacttgtgcagttcagcagtctcagcgtttcctcacccaggggaggtgtacagtttgaggacaaagccctcccctgctggcaccctccctgactgcctgggcatcttcttacggttcttgctacaaagtcagtgctgttttatccccttccctttgattacagcaatggtgaagcaaaatgttcagagtggcttcaatggatcttgtcacactggattccactgaggtcaatggtcaccatcaaggccggaatgcgcagcctacggagcagcatgagacaggagagctcaacagtgaggggtgaggcctctgggctgctgaggcaactcccagggctgcacctgcggccttttcaggattctcctttggaataccttcccttccactagagtctgcagagtggggggtggggatgtgacaagcagcagctgaggctccaccagcccacagcctccttgtctgtgggaatcagaggcagggatctggctgttgctctcactggggtacactcttggggtgcgaaaggagatgtgggtccaccaagagacaccagaatgaccagaaaaaccccacagaacgcagagaaagaagccagggaagctgaggatatctctgggctgagactggccaccaggcctgagggcagttaagaaatctatttacaatctgcctaagggcacctacttttaactttaatttggcagcccaggcatttcccatttttcccactgcctctcttctccataaactatgaaataagcaaatccttagaagacccagcagatttttatttaaggggcagctgtaaccttagctggtggtactggtttcaggttctcatgggctgtaagaacacacgtgtgtggtgggccccaaatgagcagcagctggactgtgttggttcccacactagtgggcactcagcagcgaggggaacggctgtcagaggcagcagggaaggcggtgctgataagaggatgagcagcagaagagtgcgagacgccacgaaggaagcactgatcacgtgtcaggcactgtacgaagggcttcagcagcatctcaacaaatcagtgaatcagccctgtggagtcagtactatcatcatgcctgctttacagagaatttacagattcatagatgtgtgaaaacgtgcatatctgaatgtttctgagtccccagaaatattttttgaactcctacacctgtccttcagtttcccaagaatattaaaaaaataaaaaataaaaaaaaaacccagttcatcatagacaaaaaagcttcatgatggcaactttaagaaaattcttctcaaaaagccttggtttgcatcacagagctggaagaaacccctgaaactgttatatttagtccccttcgttttcacaagctgggggtgggggtggggagggtacagttggtcagggacagagcaggtgagaacacaggccctgtggttcccagcccaggcctctttccacagcacaccacaccctctcttcttcccagcatgacctgccacttgcaatttgctaggctggcaactgcacactctggctctagggaggatcactggggacgcaattcctggctggttcctgttttgaaagagagacagtaggacttgatgggtcggggccaggctaaaaggataatttctcaccagtctgtcttgagctcatcaatgcaaatcgtctcattctgggccagccactctgtctacacagcacagtctcagtcccttgctggcatggcaccacagcccagggtgcttcagccagggtaaccacaacttgaccacatatctttctgagccctcttcctgcagcctacccacaaccgagaggcagagaaagatactggggagtgtctttcctttacatccacaaatgtgccctcataactccagagagagggggcatattccacctcagaggtctttctgttaggaagaaaacaagcccagcacttgatgaatggtgcctccttcttcttttcaagcaatctgctataaatcagatcttctttaacatgctttgagaccctcctcaggggatctaggaccagactatgccccagaggacctttggccaccttggccctggcccagtaagtgcaagtagcactctcaggatctgggatgtcaaaagcatcctttccctgctcttgctgagaaccatgagtgcagacacaatggtgggtcctttcagaaatgagaacttgcttagaaggcacaagctaatctttcttcccctctagatgaggagaatagcagcagaaatgccccgaggataaagagaacgctcttcatttgcagcagagcaagagcgctggcaaaggaagtcagctttaaccatgtcctgtggaggagtcaccccagccaccagctgctgcccactccagtcaggtgcccctcccagcagcgcggcgaccacacacagcggccaggcgggctttggcagctctccctcctggtaattataccctgggagcaaacctgcttccccttccaggaaaggcctgcggagggggcaaagggaacaaggaaaaggagcttccttatgttcaagcacactggaggcaaatctgctttctatctaattgcacaggcattccagcctaagaagaacatcctcatcaatgcatggtggcattattccaactctaaaacttaactctgggtggacttaagagaaggtggtgaccagaacttcctttctcctccgaaggttagtacattcatccaacaaacgcacgctgggtgaaaagagacctaacgacaaaatgcgacgtgtggctcttcatttaaaaatcctaaaaccaaaccaaaacacaacaaccagctctaaaagacatttttgagataactggtggaatctgaatatagactagataacaagtattattaatatgcatgtgtaataagggcaataattatgcaggaaaatgttctttatgagatgcatgctgaagtatttaggggtgatatgtcatgtctgcaatttactgtcaaatggcccagcaaaacctcaaaactatacacatacaggtaaaaccaatatatacatatgtaacttacatatataaactatattaagtatatgtgtgtgtatacatatatttaatgagtaaccactaggtagtgggcattaaaaattgaatcccacaaccttccatgcagcccgcgcaatgataattctgtggacaccacccgtccaaaccacagcacgtgtggcagaagggccatgtgagctcgaaggaagggaggaggagttccttgtgagatttaaatctatttctaaaaagaggggtagggtttccgctataaatgtttcaaattactatgctgatatcctgtgccccaaggtgatggtaataggatgcggggggtttaggacggtgattaggtcataggggtcgagcccttatgaatggaattagtgaccttatgagagctggctgtcccttcctccatgcgagggcacagtgagaagacaccagtctggatgatgtggtatggggcctcaccagatacccaatctgtcagtgccttgaccttggacatttgggtctccagaactgtgagaaataaatttctgttgcttataagcctcccagtattctgttatggtagtcggaatggactaaggttctatggcaaagaaaaagggtacagtgcaccctagaaggccctgtcccaagaggagctgcaggagatacacgggtgcccctgttcggaaggctgagctgcccgaggtcttcttcttgccttactgcaggaaaagggcctccgaggcagggagtgtgtttatttaataaaagaggctaacacatctctgggaagaggctggcttgcaagaacagcttagaaatgggttttctggcaaagggtcagcatctgtagggagggatgaacactaatttccaaggaacatgagggaaactgttagacacggggaaagaaacaagcaagccaagggggaaccacatggctcttcctgagacatctctaaagcaagagctcagagactacaacaaagcaagaaccggagatcttcccttgatggcgtatctgagacaccgtgtgccgagacaaaaggagaaggtgggaggcagcgtgaaggggtgaggaaagacagaggggacacaaacaaaggtgaactagctcgtactgctcacgcaagtggaagaaagtgagggaagagtcctaagaaaagggtagaagggacattttctgagactaaagcaagaggggaaaaaagggcagcttctccaacgtgacaaactgtctagggcccaagtctcccccaaaggggctgtggtagcagatggagatgagcaacggccactggtggagctactagaccagcggtcatccaggtgacactcttgaacaagttccctgagaacattaaatgccaaactctttctgcgagaggaggaaatgactagggtgggcggtcttttggagctataaaaagaaatcacattcaagcaatcccaccgagaagggaattcctactccaggaaagatgtagctggcagagtacttaagagaaggcattcaggaaagcttgagtttatggaacaacctgggaaaggcaaaagtccccatgagcatcttcaggagctccctatttgggcagaaagtgcttttaggaggctaaaagcacatttatgtataatctgcccaaactcaacacattttcaagttgaaatgttgttactgccctctagaggttatgacttttgtagtccaaatttgtactaatctgtaaactataattaactcggattcgttatactagaagtattctgcagaagtctttgaagtcccttccagtgtcatgatgctataataggaaaagggtagtgcttagaggcagctgtttttcattgccagtgaggctggaccaggaagaaatgtcttaaatggtagccaaaaaaacctaaattaggaaatgaaaacttccaataatgagttttgttcactgacaaaggttaaaatttctttcccctcataactctacaaataggagaaacaaaacacaaacccaagttttggcaatggtttaacaaacaattctggaggtaagggttgaaaacaaatgaccactgggagtcacagagcgctcaaaaatgccacagcaccatttcttgctgctaatcaacttcctgtgctggcttctagtcctcttgaaagatgtctcccagcgaaccccttcccagctggggctttctctcaagtatgtaaggcacggctcaaccaggatgctcctcctggccccacactcacgtggccttcttccttaccctcagtcctggctccttggggatggcaggaactctctcttccccgctcagggagctgacatctaattttccaggttctttacagcgtggcctcctctgctttggtttgtctgaaaaattctaggatgaaaacggagaccaatattacaaaacatgctatcccagattcttctgatgaggctgatgcttttcaactggttttgctattgttctcgtcaatggttgtctgcacaggagctggccaggttaaactaaaggaaatagccacctggcttcacctaggctttctctcctgaagcaccagtgttcctacagtaatctggaaaacaggctgtgtgggcacccccgccctccagactagaacacctgagccgattcaccaggctgccagggccctgttaatccctggccttttcctcttgatcatttccttgcattctcttgtcactgctacttgcctggctggtttcgcctgtctctggagggtgcacatctgtgaatgtgttctcctcttcctgtgcgctctctacctacatatcttattagttaggcgcacccaggacaaagacagtggtggggtagatgagcaagtgagaagagaaaaaccaaaaaagacatctgtgctcgagtcctctcctaaaaatgtctagtctgagggacttaggacaaagacagtacgatgacttgaagggaatgtcctaaagcagaataaccataaaactaaggacagaccgtcccccaaccaccgcaaatggaatgtacataaaactaaggacagatggtcccccaaccaccacaaatggaacgtattaacttgaaaagaattcaaaggaacattttcataggtggcagagtttatgcaacctaaagatttctctatgagcttatgatactgtgtggcaatttttgtggggacagcggataagttctgtcctcttaggattttgcatgtctactttttggcatagtattttgagatgggctatcatttctattactgaagaatttaatcaaaatttaaacttaaaaacaaaagtcctttaacatgatgttgtcagctgacagatttctcccaaacagctcccaacttcctggttgccctcagcatgctttcatcaaaaatagcaacaagtcagcaggaagtaaacagtgatctcaggcagtaccaacaaacacttactgccccaaagccaggaacttctaaggagtagtcagcctgctgccttagccagtcaagcagactcttgctgggaatggatttctcggcttggctgctggctgccgtagctggctcaggagccgaggtggcaggccctggcccctcagggtgtgtggtgctcaaggtggcctgccctgggtcttcatggacttcctggatgaaggaaaaacgagtatgtataatcacgacacaatgaaaattagtttctaaagaaagaaaacatgtaaggtgttatttgaatcactccacctatttccaccctgatattactcagctggggtgcctgaattagaaccctacacacaccactgacccacgcccacataagctcttgcaagtgatttggtgttcccttcacctgagcactcctctcccgctcttgtccacttggtacactttaactccatcctgactgccggattcagttttcctcctctgtcaccactgcccactgtcccaggcagcactcactgctccagctcctgtccccacagcactcggttcctagctctctcacataaagaaaacgccataccacaatttactcaccctctatagtttgaatgcctgtcttacctctgttttactaatgcctataatggggtctataacaatgaccatgctaaataagtgtttgcatcaataaattaaaaaaatactctgaggacaagggggaaaatttttatcggtcattccattggaattctatgatcattatagagaaactatggtgttgcacatctaaaaaaggtaaaagacttcttaaaagcttgcaggattgagcagggaaagaacgtgtcacttcagcttcccagattactttgaaagtctaagaggaagacataacccaagcaatatggcttagcagtaaagttctcagcccctagagaaaaaggtccttggtttggtttcctgctttgtcacttactagctggataatcttggggaaattatttaatgctttaaagccttattttcctcacctataaaatgggaataacaaagcccatcttcagagtggttgtgaggaacaaacaagataatcatgtaaagccttgaacatggtaagcagtaggcactcaataagtactagttattattattgcttttaaaataagaaaacataaaatgtgattcctgttttggagctcagaatccagtaaatgggaaaacccaaaatacaacatgaaacattaaacaaagcgtaaaagggatctctcttggccaggtatacggtttctgaccttttctgttgtttgcaaatgatttcctttgagtttggaacaaactgtcttagcatgatctccgtaaatcttcaaccctccgtggtagatgctgttgccccactttacacaggagcaaagtgagtctcagttgtagcccaatatcacccagtaagtcaagcagaagagccaggatcacattcaggtagccctgactcctgttctttctcccataccccagtcttggagagcctcactaccccggagaaaagccgctgcacactcaaccctgccatcttgctctgccgtgccgtcaacagtggctcttctgaaaccctggaggagcggggttgttcctatttgaaatggcaagacctcctggctcatttctccaggctgtaagcagattaagcgccattaatgagttagtaactatctagttctacagaagatggagggcatcttataatgagagaaaataaagcaggacaaccgaaatagagataaaagatccacaaattattttgcgtctgaggaagaagggtttgtttctcagtgtagaaaggtaaatgtttttaatctaatgacctcaatacccaccaagattcccgcctgaagtgtctgctccttcaaaaagatgaggtccatccctccttcaacatgtttccgcctccctctccgcctcctcgtggctgcatcatctcttctgaggcttccattgacaatctgtccagtcacaggatggatcaggccagcttgcagaatcccagacaagtccatgccaagggctccctgaagtgaactgatagccccaatcttaggggtgctggcgctcactgggaaaggggatgtggctcctggggacccctctgatgagcaggagaggtccatagctgactccccatgccagccattgaggatgataggggtgtgcccgtgggtggcagagaactgctccaggccccgagcctttgcatccctctccacctcaaactcatagggacgcctgtgcttttgttcatcctttgtgaatactggagctaagaagctctcctgtgaacacacaaacagcaagagaggtctgaatgtcacacaagtggctgaatgctagctctttctccaggcctgatttccctaggcctcatattgtttccaatcatctttttaggagttcttctaactcaggcctcctcaaacctgaacagcttgttaaaatgcagattctacttcagtgggtctgaggtagagcctgagaatctgcttttttaacaggtttccaggtgctgctaaagctgctatgctagtccgtgaactacatttggtgttgcaagatgataactcagaaatgctcaacctcacctgtgcatcagaatcacctgggaagtttaaaacaactcagtacccaggacacactccagactgaataagtcagcatcgttagcttgtcacggtccccagctgattccaatgtgcagttgagcatgagaaccagctagttaataatgtatctcaaaactcatcacccccaccaaaacgctcactcctgccttgatttccctaatttctatcagcttccattgttagagctcagttctctaagggtcaaccacactgttccattcatgcttccctttccttatatatttattagtcatggggtcatctttgccagttcccccctatctttgtatccactctgaaacaaccggggtctagaacctctctttatcagtttcctgcttggcccccctagccaagctgtattctactccaagtgagctgcaaacctctgctttcatcatgccttctcctgctccaatacttttactagctcttcactacatacaggataaagtctaaattccccaatcaacactaatggcttggcaaaaaaaaacccctatccactcagtaaatacttgctgaatgaatgaactcaacagagacgtggaacacgcccaccattctttgttttgtggtcactccattcttgccggctcaccttgtggatctgggccgccaatgctgcgccgttgctgaagctgtgttctgctgcttccggctctgagaggctggttcgagaaccagcactgctggttaataccggggtgggcagtgtgcctgagggctcatactgctggctagagggccacttcccctttaacaccacgtggcagatattatctaggcggttaattatcacgcggtcctagaaaaaaggataaagctctgatgaataaggatcgagttacctaaattcacaaaatcctttgagatcaagggttaagcttttcaccagaaggagtcgataagaaaagagcacactcaaacatactcactttataaggcttaaaataaaaatcatagtctggacaatacaaattaaagccatcgtactataaataagaggacaatttgacaccttcatcttacagtcgaattagttaagcgcatgtatctttaatgttcaaatgctacataactaatatcttttaaaggtattaaacatttctgagtttcttgttcagaactatttctaaaagggttaaaaaaagcaattcaaagctgggaatggtttgggggtagggtgggaaacgcaagctctggggtacctttggccactcagagaaggaatagagagttttctcctgtagcagctgagcaatagtgggagctcgagcctcctgtagctcatccccaatgtctcctgtgatgcccgatgttgagctcttgctctcctcttcagagtacttccctggataatctgggaagaggttaaaaaattaatcaggcacttaactatagtagtgagatactagtgatctgagagattaggatatcctcttttccttttgctttttaaattagctcattctgtgctattttaaatggaatattaattatgatatcttctatttccaggagaaccgtatcagttaagccataaaagcaaatcctgctctggggctcccaaggcaagtcttctagtgagcatttgcatccatatcccaacacaagaaaagagaaaggaaatttttcttgtgtatccaagagtgaaagagatgactaaccacaaagaggcttctcacttagtgtagtggtcaagggaaagctgaacattctaacactttgagatctttgaagggacagtctatgaaatgtaacacggcaagacggtgattaatatgagaaaggatgaaagtcatgaagcttacaacaaaggtaagacagacctgattcatgtaaaaaaagatgccaagaaactcagaacatttcaattacttcactcatggaaagaaatggacatgtaacttattctttcaagcttcagtaatggtgaaagtttatcatcaatgtgtcaacgtgaatggatcttcaaagatccacttacaggaaatgaacagacaatggaaaaacacctaaggcaggaaaagttgttgacctctttcttggttaaatgacaaggagcatccatcctttgaaatgtggctatttcacttctcaatgtgcaacaagtctcctagggagctgcagcgacctgaccatgaaaaacagggccttgctaggcctggtagactcaggataagccagacagataccgcccaggtcctcaagattcttacagccctatgagggaagacagccaggaaagaggtgacaataaaggagcaactaaaattatcagctgtgataagtactatcaagggaaagaaacaagacgccatgatagggaacaagagggaagaacctactcaagtaggttgttagagagtctctcggaggagggagctcccatgaagatgaggaggcaacagggaagggtattgtggacatgctgaggaacgaagtgagggccaggaggaaagcacaaagatgaggctagaggggtggaaatcatctagaacatgctgagtcctctaggccagaatagaaaatttagattttattctagattcaatgggggaccaccactgaaaggttttaagcagaggagttgaatttaagttttttttttttaaaagcaaaatcatgtgagacagaaaacctggaaaaagccaggagacctgggggctggccctgacaggtgtaccaattaattactgctccttcaggactgtagatttctagtctcgaaagcagggctaatcctctctggcctacctgtcccacacctcatatgtgtggaggatcccttccagggtctgcaaaagcacttttaaaagcatcagtgaaagggactcccacccacgcgtgcacatgatgctcaccaaagcttattaaggtcactgctccctctactctgacttagcaaggctgacgctgccatcaaaggacaccagttcaggaacataatttctcctctaaaccatacttatctttaccttgtactcacttgattgcctgggtttccaaggactgataatttggttatttttacccgcaacagggttcaaaaagcaatgtgggttttataattcaacacatggcagcaatgcttcgtggcctgccatgaggaggatcaggcatagttgtagactggctccttctgggttggctggggttacaactctatcaagctactttcaatttggcttctcggtttttatcttagctagtatgtaaattttaatttgggttcagactcttcccaagagttctgaataactaaaaccaagacgaggagtttaaaaataaaaagctagataacctgaggctgggtgcagtggctcacgtctgtaatcccagcactttgggaggctgaggcaagtggattgcttgaagccagaagttcaagaccagcctggccaacatggtgaaactctgtactaaaaatacaaaaatcagtcagacgtggtggcacacacctgtaatcccagcttgggatgttgaacccaggaggcacaggttgcagtgagctgagattgcgccactgcactccagcctgggtgacagagcaagactctgtctcaaaaaaaaaaaaaaaaaaaaaaaaaaaaaaaaaaaaaggctagataacttgagggacttagcttagctcctctctttccctctttaacataaaatcagtgctccagaaagggacaatgtgtctgtctacacccctcagcaccacagtggaccaggcatgaaaggagttgtttttggttttttgttcaccctaataggccttcttggatctgaaaaaaattaaaactacagctaacaatcattttgttgctgttgttcctcaggatccctgatcactgtatgtctattcttgcaaagcccatagaatctcagggtcacctagattcttaacattttgaaattccttctagcttaaacccttatataagatttccctataggatcagatctattttcttcattgttgtaaactttttatttctgttgagttactgaaaggaatctaaatcaaatgcactgaccttaagccacacagttttgacaatgacatgaataaatggcttttttgctcaccttaacaaagatcaaatttatttgtatttttgttcagttcctgaaaaattaactgcccctatattaaagtgcaagttcctaacatcccaaggctgttctactttagccagtttgaagcaccttatctaggggaagaacaaactatttccccttaacaccatacatagcatctattgaatgaaaacacacaagcccctgcccaaattatatgagtgaggcagccaaactgctatgattgtctatgatcttcaattttctacaacatgaccacagttactaagctactcgaattttcagtccaaggcctatgacctttggtgagggtaggcaggtctgtttcagaagctgtaaaaatatgaagcactctctcccctaaaacccaaccccccgtcgtgtgtgaactagtttatccaaaatgccacaagatcctacatactgtaccttgactatggcagtttccgtctctatcataatcatctttattctcaaaatccatgtcttctgatttgagctcacttccttcaagaggatatgtggggaaaacgttttgcccctctgcactttctttccaaggttcttttaaaagctcatgcttcactttaaacggctgtgatggaatagcagtgggttcaccctccatggcgatagtattggttttacttttgaacagatctgggatataagccttgggtttctcgatttcaaattcatcattctcgaggccatgcatccacctctccatgtgtttgcagtggcactgacaggctgctggagcggggaaagccctctgtagcccaggagtctggtttgccacctctaagcttcctttcttggtttcatcttggaagccttggttcttttcccttgagatgttagtagtgggctccgtgagatgcaatacctctggcctttcccccatgcctactgccatggctaagttttcctcctcgttttcctcctcttcttcctcctcatcactgtggttctgactcaaaatcaatttactttctaagcttttgttttccaataaatcaattaattgctgatctgatgacaggtttcttttggagtcacagacactaagactgcacatatctacaaacccactttcatttcctggattcaaggaaggggaagctaaacacttggcttccagctggccaatgttttcaggtctctgtcctgcctcactgcagcagagctccccttcctttgaaatagacatcaacaaatgttttccatttttgatgtttgcttgagctactcctcctgcttctaagctacccataaaagtagggccagaagctatttctgcctcagggccaccagactggcagttcccatctttgcttattgagatggtaataacatcttttctagattcagtattggtacttgggctctcctgaaaagagcttggttcttggctgagcaccttcttaccatacatcatgctctctaaggactcaggcagcagactttcatcatggttgatggaaatgacatcctgaactttagaaataaagttttcacatgtcacatcaggcaggctgagatgatcatctctgctttctactctcactagattttcaggttcattttcaagggactctgaagtcctactcatttgagaatatgtaagagattcatataacttggagttggtctggtaaaggcaacagagatttcctggtgcctgggtgccagatcttttatgctgggcatagtttctataggcatccaggaaggacagctgggggtcgttcatgatgtaacagtcagtgcggttcagcccatgtttggcagtgccgatgagcaggtctcgatcatgcttcccacactcccaccagactgggaggtagaggctgggcctgcacagctggaggcgttcatgcagctgagggcacttgagcacttgctctcggactttccgtaacagttcaatgcggtacagagttcttgcagcacgttcctcagtgatgggttcaacgtagatggtggtatctgggggacctggagagaaagggaaataaagcctatcactgaaggtgacctcagacactccccgcccacctgagcccctgcatctttggtcttggagtttagctccctggctcctcagcatggcagtttcaggtgtgtgagcccttgccaaaataggaaactgaaaaagaatggaaggcttttatgaaacaaggacagacccaaagggtgtgaaagaagagcataaaaattccagttctgaaaacagtattagtttcctttaaataagcatgtactaggccaggcatagtatagtagtagttcacacctgtaatcccagcactttgagaggcagaggctaggaggatcacttgaggccaggagttcaagaccagcccgggcaacaaagtgagaccccaccccccatgtctacaaaaaataaaaaaaattatctgggcatggtagcatgtacctatagtctggctgcttggaaggctgagacaagaggatctgggaacccaggagtttgaggttacagtgagctgtgatcatgtcactgtactctacactaggtactttatacacatctcttagttctcatgaaaatcctaccataccatcatcatgcctgtcctatttcaaggataaggaaattggctcagataaactaccttgctccacgtgacagaaccaggatttaaatccaggttttgtcagtgtgactccaaggtccaccatctttccaatatattcagctccctggcttggatgacaacactttagccctgccatataggaggcaaaggctggtatgtcttgtgcgtgctgccatcagccctgaacccacactgagtaggctcaatggttgctttggctttcctaaaatattgtcccatgatccagaggaactccatctacaaatacgaggctacagggaggcctgaaggaagctgttgcaagtgccaaccatgaagacatttttcaaaagggttctctattgcatcaggggatatttaaatgacagccacttactttctatagttacaagtcgacatgtgaggaaatacttaaagttattaagacttaatctaaggaaggtgcaaagttcagagtaggataaatctgaacatgacttaaaaaaaaccatgactttaaaaaaacccttatactttggagaaagtggttggcagtcttccaatatttctgtgatgttttaagctgaatttcaactttcactgaagttacatcattttgggagagagattttattttatgaggtggacccaattagaagttcatgaatttctaaaagccactcatctttacctaaattcctcatgtagactctagtttttataggtatacctaaagtaattctgcaatttgaaaatcagaatgttctttccttgtatcatctgacaatatactgatagttttctcaccgccatctttccatgtgggtagacgacagacattccggcacatggccacaaaactataaaaatactgttccaggctctcatccgacttcttgtccaaacgggaaatgatgcggaactgtgtccagtcaaaggttttcttttcttgatcgtaaacaacaccaaaggaagacactgttctatagaagtctgcttgttctctcctagtccaccttgagatttaatcagaaaggaagagtgagctctttcttctttttttaaagccaataactgcttattgagagcctactatgagagcccataaagtcaagaaaggaggcagagctggtttgtctcttttattatttttatttaagttaaactgggctgaagggcttataatgaaaacagcctattatccaactcccaaagaggtaatcacttccaaatctttcagctctttcttctggtatttacctccctatttctaaaccaggtatacacttgctatctcttgattcatcaattttaggaatcacctagttaacttctgcctgtagatgatgaagatttttaaaatactatatatgcttaaatatctagccttatttttttttacccgtatggcaatatagaagcagagaatcctgaagggatgttccagaccattaaattcaacctccttatcttactggtgtcccgaagggaagtgactacttcagtgacacaacccctgcctccccatctcatattgcttttctttgtggttttatgtaggtaggttgtccatgacaattatcttctctgggacacaaaggtcctctagtctttatatcctatacgagtaagtcaatgacttaagggaggtggataattatataccaccatagccattatgaggggctcctgggcagggtgctctccaatccagagggagtctagctaggcatgggggtaacagggtgaggggttagagaaagagtgagaagcagggaagaagtggctctggttcttctctttagagatgtgcaagaaggaagacatatattccttgaactatcgaatttcataagtcaggagtacagagaagtaattaaatttgttatgcagtcttcttttaattcatggggtgtttcatcagaaagagagatatgactcaaggaattgcagctttgttgataccttctggtggcatcatttctagcctatgctggccttctgtaagccttttagggcttaattctcagatgggcaagtcactgctggtaatttattctttccttctgggcttgtattttacggtatttattgccctggaaggcttgataaggatttagctataataagacagcttcagtgcatactgttccctttgttactaaaataattagggggtctgaaatggtctgacacattccattgtggtgtttctaaaccacatccccagagactggggtttaacttaggaagagtgtcaagttagaaaatcataaaaatctggaaactgtaaagacagggtgttcctagacctcatcagactcccatcaccatgataccatcacaactgaaggctgaatgtaatgaattctggagacaacctaacttcacatgagaacagaaatatactcgccctccaagctaccggctttaccttttgaaaactttacccagtgggtggctgagcatgcccctttggccactggcttttacctcttttgggcttccttgttgatgaggtccatttctgaggttctcctgaacatctcttcctgaacccaatatccttggttacctggtcccagaatttcaggccggcacagttccttgcggttgcagcgctggtaaacagtgaccagacgtctgagacgagctgtgagggcggaggaaactggccagggcgatttgtctgggtcggagccatcctgggcttcaaacatcagtgaggatattagtatttacaaacagaactaaaacaggagtgactgtcttttggttttgtttaaataaaaacaaagctgactcaataatttactcaaagtagttactgttttaataattggcccaggagcaaggcatgactggaagggctgcaattttgccttggatacagcttatgttgtggtcaattaattctgttatctctcaaacacagaagtgtctttttgtggtggcagaagttatgtgaggactttgctctaaagcacaggaatgagcagatcctttgttgcctgcaccttccaattaccaaagctcctctcacgtctgaattcagaaaattcaaaaaccaaaccaaactaaaccaacccccacaacctttctttaaaaaaaaaaacaaaaaaaacaaaaaaaacccgatgtcatcacaattcctttttacctctcagaccttattctaactgaagatattaacatttacttcactttcaaattttaatgccaggtagaggaagccagagccatgctgaagctccatgtgtgactctaggggagtttgatgatggtcaacttacttggctttttaaaagagcctccttaaaaaactacttattaattacatataaactccacgataactaacaaactaagaccttactttcctatgccttcagaaggacatagtctcacctgcccggctgtcatccttcttttcgctaaaaacgccatcacctccatcactggaactctcctagggataaataaagccatcccatcagcaaaactgcagcttagaagaaaccagctcagaaagtcttgaaacggaaagagtaagcatcacgcataagagctgtcccctgcccatgaacaactcagaccaagataggacctgataaagcttacttctgtacaatcttaaaagagccagaaagcagtttatttaaaataagttttttttttcttttcctggaaccatgtggaatgcttctgcctgtagagaatcggcttgagcaatgatgaactggcacgctctctctggcaattacattttacaagtactattttagttgtgaatttaaatatttgccttaccatcgtcacttgcaatttaatactgtcatttcatttcacaaaggttgtgcctgcatttctgttcttttgctgtgaaaaagtgtcatgctcatgttcattatggttagcttacttcacagcaacagacactattttcataaaacactactgctccagacatgaaacctgatggcgcaaaaccccaggaatttaaaattaaaatcatgacttgagctctaagtgaatctggagtaatatcacaagcactgagcttgcccaagtcggtgtatgtgtcaaaccagctttaatgaattccttcgcaaatccttcttggtctcaggaatggaactttaaaaactcctcatatgtaattcaggtgggaatctgaggggtaacagaagtgactgtgctatttttcaactggactctaatttcaacactaaaacttactatattttgactagcatcttttgacctgaatgacagtacagaacaacctcaggattcaagactttgctattttagagcacagggtcagaaagaagggtcagcaaactgcggcctgcagactttctgtgtggccctcaagctaagaatggttcttacgtttttaaagggtgaaaaaaagggaggaagaatatgcaacagaagccatatatggccttctagcccagggtatttactatctggtcctttacttgctacttcctggaatacacaacatggtagaccagtaatctagtatggtaggaaaggagacacccatgactgccaacagtgaaaattcaaaatgctcttttgggcccctgatacgacgcaaagaacaggagcccattttctgaatgaatttctctcttacgcagaacagcgttaacagctaatattacggagaactacgtgttaagcattgcacaaaaccttttacatggctcatctcacttagttatcagcactgtctcatgagatagaaaccattactatgctcattttacagatgcagaaaacaagccctagaaatgttcagtaacttgcccaaggtcacacagctggcaagtggcagagctgggattcaaatacaggtaatctgatttgagagccaacactttcaactaacaagctgtctaaaaaaggacaagagagtcttagatgaaaatttgtcttggagagtgaaaacatatttataacagaagtggggaacactagctaacctcctttgcctgggccagaattgtctcctgttatctaatgttaatgaagagtgaaaacccagggctgatctactgtaccattttgaagtggcagttaaatataccattttatcttatactactatttaggcagttaaaaaaacaacctactatgccttatataatttcctgccagagaggactttttaaatatccccacagtatctgtgaagatcctttgaatgctgaaatgtataagtgtagtacttccagctgagaaatgctctacagtctacacaacacaggtggcaggccccagagctaccatgttccttcgtgccatgtagtggtggctgacatgggcatcatcataccccaagtccatgacaacaggctcccagcttggtgtgaggcaggcatacagcaaatgctagcttcccttccagtccacctagtagtttctgttggtacagttagtaaacatgaatagttttaggcaaaactttcaagtaaggaaagctttgagcattcatagtgtttttctgttcctgtcctctcttgaaggtacttcctctctctagaaatgacagaatgaagaagacctagtttgttagtagctcaagtgaaaaagatgtcagacttttagttaataatccgtttaatgtgagtgtgtgtgaggtgctgtagcagtgacagtcctgagcatgcagaggccctgcatctgaactatgtagtctaatgtgtgctacctcaatttctgcttacatgattaacttgaaagaaatgttcatcttcaaagaggtatgaatcatctcacagagaagggccccagagtgctgacaagaatgtcaacaacacagcaaactgattggttacaatgtgcaatttctccatcttgaggacacacgtggtttggagtcccatgatccactgctctctggtctcgggcaagttgttttgatctctctcaagctcatttcttcttttgcaaaatggagaatggcataaacttcaggtggaaagcagatatacctcaaatgccattaacacaatattcaaggattttattatggaaagactgcagaatgtagaaaaagaagagggcaggggagatagcactcttgtgtcccctggctgtatggcttttttgcagctgattaaaactgagctccctcgtctctacaatgggcataagaataatgcctaacagatggggaaatatgctttgtaagtgtgaaagtatacacaaatactagtatttgagttcacagaaccctcaaactcctaactcacaagaagaaggtgcttgttcagttcctaattaaacttttggaacaatggaatttggccattttaggcattaaattttcctgcaagttcttggccatgacttcatccttttatgtactgacctcatggtttagagagcacctgagatgtcacagccacctacggtaggaactgtggcacagcacggacatgcatgcttttgacagcataactacaatgatgaaaattgtgctgttacttattgctatttctgttaaaagatgtgttactctccccacatactggctgtgatagagaaagattttgtttacaatttcaggctccagaccattccaacccaaatatactttcagactaactgctttagaaggtttctgtaggttcactgaatctggctgcacgtgacatctgtaatgatttgccaatcaaaagtgctactggtattaaaacagagggtgggggaagctgtaacttagatcatttcaaatctcccttcaaattctaacattctatgactctctgaacgccacattttaagaggacaacaaccatagtgtgctctggaaggcgctggaatagcaaagggtctggatatgatatgatatggaaaaatatagaggaactagaggtatttcacctgaaaagaaatttaaagaaattaaggtcatgagctggtctcagcaatttaaaattctatcagagaggggaaaaacaacagttttgttctttgtagtaccataaagaaagctagatggaacccatggaaccagctgggaggcagatttctggtgtggtaaaaagaagtatcatccaacaataaaatagacttctttggaaggtggcatgttcctcttgttttccccatgaactcccccctgacagccccgctaaagagggaacgccacactgagaccactcaggcttgtgccagggctccttgcaatgctaagactctaccaatctactaaacggttgcctttctatgcctaggtctgttgaattcaggggaactgctctaatgaacaggctctttttatacaatgctttgggcttctttaactctgcctgaggacagagctgggagaaagaaacacccaaacagtgtcttcagtgcaggaggtagggagcaagcgtgaagcagggtgggcagcaggcctggctcagatgccggccatccctctatgtgtgtgtggttttagcatgcagactagaagtaaaggtgaatccgtttataatctgtccacctcagaatctggggaaatccactccccatttcaactgcttttaatgatattctataccccaggttttaaggatatgaagagcaaatcataaatgtgttaattttgtaaatgaatacaaaagtaattccagagtttaactctaatatataagagcgcttaagttatttttattgattctgccatggccctccagtgtcctcctaattgattagctaagcatgtccagtttaatgtcagtggctttcagaggctggcctcttcatatgagctactgctgggaggaaggggcataaacccacacctgaattactctctattgtctggactacgaaaagaatacttgactacaacaaagaataccggaatatctagagaattacaagtcttagctctgtgatctagtggttgtgagaatttggtcaagtcctttaactttcagggagggcctaaagtttcctcagccctcaaatgaagacagggtgaggtgaggatcaacttaaataaatggagtaactggtttgaaaagagtcaagttccatatgagaataaggtattatgttcatttctttggtacttgagttgtttctacagggaaaacgcatcccaaattccagacaaaagcaataatataaactaaggactggaacagcagaacatgaatttttttttttttttttttttttgagatgaagtctagctctgtcgcccaggctggagtgtggtggctcgatcttggctcactgcaacctctgcctcagcctcctgagtagctgggagtacaggcgcatgccaccacacctggctaattttttatatttttagtagagacagggtttcaccatgttgaccaggctggtctcgaacttctgacctcgtgatccacccgcctcagcctcccaaaggctgggattacaggcatgagccactgcgcctggcccagaacatggatttgaattgtcaagatgagaacctaacttccttcatgttaccggggtctgaggcttcatgctgatttgcttcaatccactgcttctcaaaccttgaggacacagggaaatgcatctttgaaaaattattattatctattttaagaaagggatgaagccattgttactgttacaggggtcagagctgatggaggccaaagtaaataaataccatacattctgcaagctagaatcaacagaagagaatggaaaataatggataatttttgggtagtgatcaggagaagaagagggaggaccctcgcaggggagtcacttggggacaatgctacagtaacttctgggatccagaatccataacattctctctattactcaatgctagagaaaatttggtcatatggtgctggggcccaggtagggtttcagtctacttatgcaaaatctcagaaactcattttaaaaatgcaatacagactgccgcttctgggatgcatttccctattctttaagtataattaaaccctctggatagtaaatatgaaacaagcataagaaaactctgaaaggtgaaaaaaagaaaggacaaactagagacctcaggactcaaggaatgacatgatgaaaaaacatgctttttttttttttttgcttcatatatcctagatttggaggtaaagaagcgggctacccggaaatggcagaggcagacaaaaaaggccctcaaaaaaaaccttccgggcgcggtggctcacgcctgtaatcccagcacttttggaggccaaggcgggtggatcacctgaggtcaggagttcgagaccagcctggccaacatggtgaaactctgtctctactaaaaatacaaaatattagctgggcatggtggcatatgcctgtagtcccagctacttgggaggctgaggcaggagaatcacttgaagctgggaggtggagattgcagggagccaagatcatgccattgcactccaacctgggcagcaagagtaaaactccgtctcaaaaaaaaaaaaaaaaaaagaagcgaggtggcttcctgctctctctagttaaggactaggaagaggtaggttagcaggttagggacacagaaaatattaagacaataactgctataccccagcccaacaatgcagaagaaactgtctcaactctacccatggcaacaacggctgagtgggagctcagacttctactttttccaggtggtaatagggtaccccattcccttgctgggctggtatcagaaaaagctaagcaggaagtcaggactttcaaccctgacaagtagtaatgaggttccccacccctacccatggtggagctaaacttccattcctgctcaaagtaatgagaaacatcccctttaggggttaatgggagcagactgggaacatgaatttttgcttccacctcacagaaacaaggtgccccccccgacctctgttcccctgccaagaaaggtgctgaaagagaacgtttaaataagatccagagtctcacaatacaatgtccaaaatgtccaggttccaataaaagatcacataccaagaaccaagaagacctcaaactgaatgaaaaaaagacaaaagtggccaatgctgagaggaaagatcttagaatgatctgacataagaatttaacagtcatcagtgagccattctgaacatggcccactgttcagaatgaaacagtgaaatgaaatgaaacagaaagtttcagcaaagaaacaaagatccaaataatatttggattcaaagggaaattttaggtttgaaaagtacaataaactggaacaaaaaccaaaaccaaaaatgaaaacccaaaaccctcaggagaagactcaacagcagaatggtggaggaaaataatcagtgacctcaaagacagaaaaatggaaagtacccaatgtgaataacagaaaaaaaaaaaaaatggacagagccttagagacccacaggtctataacacaagatctaattttcattttattggtttcccagaaggcgaggagaaagaggacagggcagaagaaatacttgaagaaatcatggctgagaatgcttcacatttagcaaaagacagaaatcagatttaagaagacgagtgaattccaaatagggtaaactcacagaaatccgtaagcacataaaatcataaacttctgaaaactaaagacaaagaaaaaatcttgaaagcatcaagagagaaaagacacattaccaataggggaaaaactgcttgaatgacagatttctcatcagaaaccatggaggccagaagcaagcggcagtaccttaagagctgaaagaaaaaaactatcaacccagaatcctccatttggtgaaaatatcctttgggaacaaaggggatattaagacattctcagatgaagaaaaactaagagaaccgtctgacagttctctagactaccttaaaagaagagctaaagagatttctctaaaaagaaagaaaacaataaaagaaggaaccttggaacaccaggaagaaaaagaacacagtaaaaaaaatatgggtaaatatagcatattttccttctcctcttgagttttctaagtgatgtttgacagttgaggcaaaaattttaacattacctgataagaaatggttaagacaactatattataaatggaagagggtaaaggaacaaaaatggaagtaaggtttccacacttcacttaagctgataaaatgatagcattagtagacggtgatacattacatataaatatatgaaacacctagaagcattaaaaagctacaaaaataaagataaatcagaataaaatcatacaaaatactcatgtaaaccagaggaaggcaggaaaaataaaaaatcagggaaaacaaagagaagacaataaaatgacaggcttaagctttaatgtatcaataattacattaagtgtaaatggtctgaataatatcaactagaagacagagaccggcagagcgtattaaagattatgatctacctgtatgctatctataggaaactcacttcaaatacaataaaggcaggttaaaagtaaaataataaaaaagttatatttatgcaaacattaatcaagggaaagtagccatattaatttatcagataaagtacccttcagagcaaagaaaattatcagagtcaagagaaagacattatatagtgataacagggtcaatctgccaagaacatgtaattctctctatacatttttttgagacagaatctcgctctgctgcccaggctggagtgcagtggcgtgatcatggctcgctgcaacctctgcctcccgggttcaagtggttctcatgcctcagcctcctgagtagctgggattacaggcatgcaccaccacgcctggctaattttgtatttttcgtagagatggggtttcaccatgttggtcaggctggtctcaaacccctggcctccagtgatctgccttctttggcctcccaaagtgctgggactacaggcatgagtcaccgcgcctggcaagaacatataattctaaatgtgtatgcaccaaccagagctgcaaaatatatgaagcaaaaactgatagagctgaaaggagacataaataaatccacaattatagttggaggcttcaatattcttctctcaacaactgatgaaacgactagacagataatcagcaaggatacagaaaaactcaacaacatcattgaccaacaggacctagtcaacatttatgaaatactgcatccaataaaaccaaaagcatgttctttccaagtgcccatggaacatataccaagatataccatacactgggccataaaacaaacttaacaaatttaaaacaactgaaatcatatagaatgtgttctctgattataacagaatcaaactagagatcaataacagcaaggtaatggggaaatctccaaacacttggacactaaataataaacacctaaataattcatggaaagtctcaagggaaattaaaaaaaaatacattaaactgaatgaaagtgaaaatacaacacaaaattaatgaaacataactaaagcaatgccgagggaaatttacagcactaaatgcatatattagacaaacagaaaagtttcaaatcaataacaaagaaactcccacctcaaaaacctagaaaagggctgggcacaatggctcatgcctgtaattccagctctttgggaggccggggagggaggattgcttgaactcaggagttcaatactagcctgggcaacagcaagaccctgtctctacaaaaaaacagaaaaatagaaaaaattagctaggtgtggtggtatgcacctgtggtccctactacttgggaggctgagctgggagcatcacttgagcctgggaggttgaggctttagtgagctatgattgcatcaccacactccagtctaggtgaaagagtgagaccctgagtcaaaaaaaaaaaaaaaaaaagtaaatgcagaggtatatacagtaagattcagtactgtaaaaactcaatgaagatgtcaattctccccaaagagatataaaggtttaaagcaatgcctatcaaaatcccagcaacagtttctgtggataagattattctaacatttatatggaaaggcaaaggaacaagaaaagcaaaaacaattttgaaaaagaagaaaaaagtgggaggtatctatctatcaaattttaaaacttacggtattgctacggcactcaggattatgtgctactgacagaggaaaagacaaatagatatatggaaaagagcagagaactcagaaatagaacccacaaatatgccaaactgatttttaattttttttaattttttaattttttgtagagacaaggtctcaccatgttgcccaggctagtcttgaactcctgggctcaagggatcctccctaaaaagagacacttacagggtgggagaaaatacttgcaaactacgtatctgacaaaagactagtatctagaatatatacagaactctagaaaatcaacactaaaacaatgaaattagaatataggcaagagacataaacatttcactgaaaaggatatacagatggcaattaaacacataaaagatcttcaacatcatttagccatcagggaaatgcaaattaaaatcacaacaaggtattgctacacacctaccagaatggctcaagaaaataatagtgaccacaccaaatgttggtgtggatggagaatacagagaaagcggatctctcatgcattgctaatgggaatgtaaaatggtacagccactctggaaaacaatttggcaatttcttaaaaaacacaacatgtaactatcatatgacccagcaattacactcctgggcatttattccagagaaatgaaaatgtatgttcacacaaaaatctatatgcaaatatttacagaggacttaatagtcaaaaactggaaacaacccatatgcccttcagtggatgaatggttgaacaaactctggttcttccataccactgaatactactcagcagtgaaaaggaatgaactgttgatacagacaaccacctagatgaatcccagggaacttttctgcatgaaaaagccaatccccaaagtttacatactgtatgattccatttacagaacattcttaaaatgacgaaatcataaaaaatagagaacagatgagtggttgccaggaatttaaagaggggtgaaggcagaaggaagaggatgtggttataagacagcaacaggatgaatctttgtggtcatgagaatgtcctgtatcttgactctatccatatcagtatcctggttgtgatattgtactacaatactgcaagacgccactacgaggggaaactggataaaaggtatatgcgatttctgtattatattttgtgactgcttctgaaatatacagttatctcaaaataaaaagtttaattagaataaaaatgcaattgcagtctgtgtattttaagtttttataataaaatgttgggcaaaatgcaatgtaactgtagtaatgcaatcaagttcccccagatcactaccaagatagggatttctttcttaatatgaaagacggtgtaaatgaccaatactgcacatttgactcaccgtttgtttctggaggccatctactttgtcctcagcattgtcttctttatctgtgttgcctctaaataaaagtaaaaaaaggcatcacatactacctaggtcccccttatccacagtttcagttaccctggtcaaccacagtccaaaaatactaagatattttgggggagagacagggcgagagagagagatcacattcacattacttttattacagtatattgttataattgttctattattattgttgttaatcccttactgtccctaatttataaattaaactttatcataggtatgtttatataggagaaaatacagtttatacagggtttggtactatctgaaatttcaggtatcctccatgaataaagtggaacttccaagtcagccgtctgtacccatggaggattggttctcagatcctcagggataccaatatcggcagatgatcaagtcccttggttggccctctggatctgagagttctgcatccacagacaaggagggctgacaatagatcccttcttctgaaggcattccaagccttagtttttccctcccttgtgggagaattcaagagacactgagaatgagagaaactatcaccaaacagttatcacttctacaggcaaggacctttattcaactgagactgcagcatgaggctccagcctcacgtctactcaggcaagttcagaaaaaggtaattcctgcccatcaagagtcatctgaacatgtgactctgataaaagaacacactctagaaactgaaggctgtgcacatcaaatgaggcctaatgttgcaactccctggtcacagtaggatgaatcttcccacagaatcacatttggcgaaagtcactccttggcttggaagggagctctgctgccactggttaacaaggacattttccccttgttaccatcagacccttgatgctagctcagctgcctaatgtcttctcttttgtgagcttaactactgctgatgcctacctgtttttcatgattcttttaaaaactgactttgagggtgggtgcagtggctcacacctgtaatcccagcccttagggaggctgaggtgggcggatcacctgaggtcaggagttcgagaccagcctggccaacatggtgaaaccccgtctctactaaaaatacaaaaattagccaggcgtggtggtgggtgcctgtaatcccagctacttgggaggctgaggcaggagaattgcttgaaactgggaggtggaggctgcaatgagccgagatcattccactgcactccagcccgggtgaaagagtgagactccatcacaaacaaacaaaaaacccccaaaaaactgcctttgaaatatttgcgtcccaaatattcttgtccttgatgctcaagtcctagaggcaagataagctccttgctttaccacttaaccgtagaaagaaaagccaccccacaaaaaatagcctttatgccacattcaggcgcccattcagagagtgttttccctgaatcagtgaatgaacatgagaatcaccagtcatatgggcctctgttaacatctcccagaatgcatctcggttatctgtcctcaagaaaaatgctggggcagctgaagtgttcatcaggggttaaggacagatggaaaatgcactgcacacttttcttggcctgagcaaatagttaggggctcctggcagtgccacattctcaggtctggccacagacctgggcaatgcaaagcagtatctgctacttttggggagaaactaagagataaatgctaagagataaatgctatgttttggccgggtgtggtggctcacgcctgtaatcccagtactttgggaggctgaggtgggtggatcacaaggtcaggggttcaaaaccagcctggccaacatggtgaaaccccatctctactaaaaacacaaaaatcagctgggcatggtggcacgtgcctgtagttccagctactcaggaggctgaggcagaagaattgcttgaacctgggaggcggaggttgcagtgagccaagattgcgccactgcactcctgcctgggtgacaaagcaagactctatctcgggaaaaaaaaaaaagctatgttttcaaaaacatatatataatttgaagaactacaatttttagctgtttagttttcctatgtatttatgtcaagagtaaataaaaatcagtcaaaggagaggccttccatctacttttttgcacacagtccatggacaagctgaaatgtcatggccgtcaaggagcggcccctaaatccatcttgctcatggactatgcaatccttagacaatactggatctgaggaactgcagttcaaagtcaggaaggctgtacttgtttctgttcttagctattctgccaggcatgggaggtctgaattctcccacaggaatcctctgaccagacaagggatggacatggttagaaagctgggcaggcttttagaaaggtgggcagcctgggaaactcatgaggaacaggaaccggtatttggttcaaagtgcttggaagtcaaagagcaggtctgaggtagagtagggtgtaaccaaagtagcaattatggaaaacagcggcagtgtggcaaggtgtagggagatgccagatgctgaggaagagataaagagtgctgggtttatgaggaaggggtcacagatcagtggcatggcatgtcacatgagggctggcctacgtggcttctcacctttcaggaatgtctgaggtcccatctgtaacaccctgttctgcagaaagggacttctcatcgggcatcccaactttctccaggaagcaaagtgctgggtctgctcgcatggcattgtacctttcataacctgatcaagagtggtgagaaatgccagaagtcatgttagaactcacaatatttgctttgggcactagtctttttgttttccttatttagtaaagaacaaaacaaacacaaaaaaataattatttaagattaatgagatcctataagactatcagggaaaaatcctggtgctaaagcggacacctttgagtagtgtttgaccaacaaacaatggcttacggaaatactcagtgtccgtgaaaagacaattgtatagatacacaattctgtttgctgcttcccgtcagctggttttgcaacttcttcccccatcctcaactctggataccttgttatatcctttatgggccttgttttcttacagctcatttttatcccatgtgttagaaagggaaggtgaacatgatggatggcaggactgaaatataaagagaactacgatgattgtttattgcattaagacagacctgtggcctctgtatcacaaactcagtacaaatcttaatccacactggccagggctttggaattactcctcatcacaccccaaagttaacaacagacagtgttttgacccagaagaggggcctcaaaaaggaagcaaaacaattttaaaaaccctgattttgtttgataaagtccatgtgtgaggatttattttattgaacctaatgtactcttagaatgagacagcatttggccacataaaaggcagagtccccatcagaggagatggaagagctgagtgtaaatgagaaccagcctggctcttaggaacaaacctgatttaactgtgtttggtatttcatttctattttggtttttgttctcgtatcactgttgatgcagttgtatccttcaagctgtaggtagcacctggttcttttccctgaggagctgtgggtagctgatcttttaatccacagtggctctcctgccatctccatgacaggtgctgcccacatgaggtacctggcacgagaagctctgcagtgccttatgttctttactcacttactccttatggcaatgacttgattgctctaagtctctcatgaggtcgtgagcttcctaggagcagaacctgtatctgtttttgctcatcattatatagtcagtacctagcaaagggcctgacactgtacagactcaacaaacaactgaccagatgagtcggttttgcctagattcttttctcttccaatcactgttgtaggaagaagaaccactctcaccctttccccacgttcctgccccacctcacatcaaacagaaaattccccaatactcctgcttttaaggaggttccagtcagtttctccacctgcttctcatgaagagaggggtaatttaaatgacaggtgagatggtgaaatccttcccttactgtccccttactactgagggaggccaactgtccaggagtataccaccttcacactctgtgctcaggcatggagcaagctgcgaccctccctgacctgggcaagcttctattctgtagactttctcttgtcatgtgtggatctgaagcctagagacagattcagtatttttatttctcaattagctgtgaagctggaggtgaggaagaatgactctttcagtcccctagaaaaccctaacaactgtcctgaagagaagccagtaggagctgcaacagcaatacaaagacaaagagcaacgtgacagacccatgagggggtgtcggctgcctgcctcttttcacttttagtctataagctgctctctaagaatatcaacagaaatactaaagtctgtatgtcaaggaaaatttcacacatccaggctaccttggaggggcagcagtcactcaactcaactgagctgtcaagagcataatttagaataggtttgccacagaaatctttttgctgcaggctaaagctccaaccaaaaactaagccaatgctaatggggtcagcttggagatcgatctatggctatattcaactcatttaacagggttacagcaggctatgtctggagtggactaaaagatccacaatcccaggcatggtggctcatgcctgtaataccagcactttaggaggctgaggcaagaggattgttttgagtccaggagttcgagcccagcctggtctgggcaacatatgagatcccctctctacaaaaaattaaaaaaaaaaaaattagccaggcatggtggtgtgcacctgtagccccagctacttgggaggctgaggtggacagatcacctgaacctgggagttcaaggctacagtgagctgtgatcacaccactgtactccagcctgagtgacagagtgagaccctgtctcttaaaaaaaattcacaaaacctcagtcaatgaacagtcatgtgtttcttaacaaagaaaatggttgcagctctacagctcatacttaaccaaggcatgcaggtgaagtggagcgggcttcctgacacaatatccctgaaaagtgaacactagacagactggctttctgaaaatggctaagtatcacatctccagagctgctgagtatctgagaagctgtcacctggtaagacatgttgtgtgggcttggttatactgtgataagggcgaaggttagaaaggggtggtcagatgtgttacctagatgaggacatgtctaagcctaagctcatggaataggcagcacccaggcaggggcaggatctgatatggactctggcgggtgccaaagaggatgggcccatgaggcatctgtccaacctcatctaagttgactccaatgtaaccatccaactaaactgatctggccctatgcagagtctgcatttatggcttaggctcagtctcctagcactgaaaacagaggctttttcttctcttgtctttatagcattatctgctaaactcatcctgtacaatgagacacttcagacactgcacaaatcaccttcaaggcctctgcccctcagctgtaactgtaaattccaagttcacctcaactgacaatctgtgagaatctgaatggaattgagtgatgaagtgtcatcttaacatctcacaggtgtgatcagcaaacacaaattaatttatactccccaaaactgcttcaacgagcagaagaatttgggagcgaccttatgtatcatctgggctgactctatctccaatatgagactaagagatcaactgattaatcccaataccctgaacagtgattagggattaggaaactagaaggtagggcaccaataataacctgtcttttccaggtgagaaggcatcttggacctccttagattcctgtccatttttacacattctaaggctatgtccttcacgtgagaattattaattatatcttcctggtgagttgtatctatcatcattgtgtaatgaccccctttcttccaaattatgctttttgcctcacagactgtgtgtgatattgatttgccttaccgggttgttagtattttctggggatgtcttgtttcacctcttggatgtcaacctcactctgtcctctaagtctcatcttctctttcatgtcttcatcttctttatcactcagggatctgtttctttagctctgctttcttggaccacagagctttttcttgcttccctttcctggaggggcagccctttcaaagtcatgttttccatttctgtgggtattaaaaacccagtccttctggttcactgtcatattggcccctaagctttcagttctggctttaaatgacttctgcatttggggacttcccttatttcttccaagtcctgatccaccttggttttctgtatgtctatggtgggtgtgttggggtgggggaggaagaagtagcagcatgtaaattctacctgccatacttctgggacttcagatgtgttctcttttctcagcatgttgttgccatgcagggacttggcaatgtgccctaaaaccaccactgaaatgagactcagggtcactaggccttcccccacaaaccaaattcagatgctctggaatctggctgcctttagcagcctactgtcttctggggtccttccaaaactaggttaaaccaagtctgggttgcactgcggtaccttgtgactaacagggagatcacgcacttccttctactttggagctgagttctatccctgcactgtccaacagaggagccactagctacatggggctatttaaatttaaattaattaaaagtacataaaaatacacttgctcagttacattagtcacattttaagtgctcaatagccacacagggctagtggcttccacagcagacagtgcagaattagggcatgtctatgattgcatgtagttctaccggacagcaccgctttagcctaaccccggcggtttgacaaagggttctcagcagcactgcaccacctgaagcctgcattctcaataccagtatccaagttttgagtggattccaaattaaaatatgtataggcatggttgttacttaaatatagctggttagcctgtaaaagttgaagaattccctttaaagaatacgtattagaaagttaacaaccttccaaaggcagagtaatatgggagagtggaatagcacccagcacctattatgtaccaagcactgttctaggtggtctacatttaatgtaatatttaatctttaaacaacccctaggtaggctgttttgatactatacctcctccattgtataagtgagaaaataagagaagcttatgacttgcccaatgtcacacattttagtaagtagtggagttgatagctaaagccaggtatacctaactcttttcactttaaaccttgctcctcattttaaaatttctgttgattcacctggcagggaaagtgtgtatcaggcatactatgggtgactatcacttgacactttcatcattcattttaatggctggcagttggctgaaagcaagggcagttgtttcaaacactgccagaggtgaagaaagggagcacttacttcagtttttccaagtgtttaaaaaacctctcagtcccctttagtggctcaattaccacatttttaaaaagacagtctatgctatcttctatgcttagtttttaaaatgccagtggggtaaaagatacacactaggaagatgtagattatcgagaatgaccttataattctgcatatataagaaatgctgaaacttagcatttcccgccatttatttactccttcattcaaggtgtctactatgtgccatgcactgggactattagaggcagtcccatatccgacagcatggacaggcgagggaggaagatatacaccaaacaggttctttgtggcctgaatgttcctcaataatataaaattcgcagtattattgtgagccatacattcatctggtggaaattccaagagggcagctgtgaagctctactttttaagatgaatgtgtaacagaatgatagagttttgcaggaacatgccgagcttagttggaggggctgaactcatccttcctgggggaaactgatacagaagggaacgccttcagagaaatacacaccatgcttgaacacgccaatgagaagtgacttatcggcttcagcatcccaccagtccactgggatctccatgtagtcgatgtcaggcagaggtacatccagctccctagggaaggaagggtgtagactcaaaacaacacaaaagctactggtccaaccctggtattaggccacagtcctactggcatgctgagatgctaaagtaacaataaacaaaagggttaggaaggctgtgggtcattgtttctcaaccagggctttgcatgagaatcacttaggcagtgatttaagcataagtacttgatttccaggctctacctttgacagactgacacagtcttgaagcacctcttggagaacgcaatgtcagttggtccagggtggcatcttgggatccatatgtatagagttctaatgtgcaccttatgtgaaccacagcaaaggccattgatatattggacatctgaaggtagagcttccccaagagttgaattcatacatgattgtatgtttaaaatagtgcccaaatcatcgtggctcagtatgttgcctcaacaagtagagatcttacgcaccatttaagaccaagagtccacactggaacaagtcggtatatcaggagggcctttcagagggtaagtgccataacaggtggcacctcctggcagtggtctattagatcaaaattgatcaaaaactgcattgttcctggccaaagggatgcacataactcaccccagggcacagacatgcaggtgttagcccctctctgagtttctgtaacgtgtttggagagctcacataaaccctaagttcactgtcttcattcatctgagtacagtcctcgctctttaaggctttgaggtttagggaatagcatgcatctggatggcttctccctccccctccagctgcctctgaagtttcttcttccgtcagactcttactgtgacacaggaccgaatgctccctactagtcccagctccctctgtggggatagtgtttcctgacccccacctttccagggatccatggctctgcctgcccagtgccatggctgaatgacttttatgggatgaactgctgttcatgcctcatggcaacttctccacaagaaggtattcaacctgaagagcagcagtaagagacagaggaacgcagaggaaggaagagggtgggcagcagacttactctctctgtgttctacctagctaccacctatgacttcctacacatgacagcggtaagttcagagtacttctgccaggtaacacttgatggatattatcaggtggaattctgctgcatttatacgactcaaattgaacctgtctaccaaacacacaacctccccatccctgctggaaattacaatagtgactctgaaaggcatagaaagtggtaacagttgctgaggagcctggctctgattacaagttgccccatgggtcgggttgtctatgtccctctctctcttactttagtgctcctatgacctctacagacactagcattgctcaatggaaagcaagagaaagaagaaaccacggccccaggtaatctcaacacaaagtccaaatatcagcactcttggtattctgtaggaatgacaggtgtgcacagggctagcaaactgcacctggtgatcccatttataaactggggctttctgacagctttattaagtggaagctgagaacctggtagcctcaatcttggaaatcttgggatactcccacaggattctatagctttccaaacactaatttgcaaaactaacatgcaacaaaatgaataggccgcacatattattaatatgattagcaaataaagaaaatatgtatatgagtactaaggcaaagaacaggatggtgggtaaaacttccagtctatacatgtcagatcagtaaccgacactcgttctacagtaaatgactgttttaaaagaaaatttataacacttttgagggaaataaaatgaactaactcaccaaaagctaggtttctaagaaatggttttctcctttattttatttgtagatgacctgatgaattgtccttattctacttgcctgttctcccatctgggacaccggtcctgggcagggggtaggaggaacatgggcctctttaagcacaggcaagtttggccagctccatgaataggcattttatgtcaattctttaacgttgatatgttaagtttcatttgctttacctggcaggagatccttcaaatgctttctcagctgcttctcccagtatttcagcttttaggtagtacagcatccggactcgcaaaagtactctatgaaaggtgaacacattaatgcaaacaaattagaacccataactgtctgtgaaccacatccccaagttaacactgggaaattctgggcattcccatgtagttaatattatgaagtaatagaagagaaggcactagaaaaacaaaacattatggcagacattattatgatcattcctattttacaaaaaaaaatgaccacatcagttatctgttagatcatcctgtgagccacaggaggcagcaggaacagacagctcttctcatctttaagagtactcaccccttccatgtggccacagtgacctcttaggcagaggtggcttccgagaggccagctactgaagagtgagcagggtgaacagtggtgttttcaaacagtttcacttgtacacagttaaatgaataaatgaataaaggcaagtgtctatttttcgtggcaatatgtcttctcttctgaggtgctcaattcatttttattctgtatggaccacactcaggctccaagggaatgcatcaaacatgtctcagacaaagcaattaagcaagtatttgctgggcaactactatatgctctgcatcatgccgggtgctataggtatataacaaaagtaatgcctttcgccatcggatgacccttgcccacaagccgttatcgtgctcttgggcatcccggcctgcagagtcatgagccaatacccagtctgtggtattctgttatagcagcagaaaatggactatgacaaaggggtaaggcctctgagaaagcatcatttctacctattagatctgggtagaaagtgccactgtgggctcaagttgtaggtggaaacacacaaagttagaacttatagattggaaagaacccttattatctctggtataacatttctcatctcagctgtcaatcaactcaaataattctgagagtatttttttttttttttgagatggagttttgctcttgtcgcccaggctggagtgcaatggcgcgatcttggctcactgcaacctccccctcctgggttcaagcggttctcctgcctcagcctcccgagtagctgggattacaggtgcccaccaccacattcggctaattttttatatttttagtagagatggggtttcaccatgttggccaggctggtcttgaactcctgatctcaggtgattcacccgccccggcctcccaaagtgctgggattataggcgtgaaccactgcacccaacctgtttgtttatttatttatttttaaagcccagagaataagaactcttaaaaatttacaaccactgccaatccttaatttgtagatggtcgtagctgtcagctttagtaaaaagtggaacagaatgtcagagtcctgcctgctgagacttagctcaattagagtagggctttcctgaaaatgtctgtctccctaagacagggagagctgtttccatttctataaagagaaacaaatgtgttgacgtctaacaatatctgcagcatgagagaacagaattgaaagccaatagtattcaattctcctccaaatggaagggaaatcaattcagaggatggatggacaattccttatagccagccccctcctccaagctggtgtctgaactcaaagggacacacaactgcagcaggtttgtaacacccttggtttagccaaagaaaacaatccattaatattttgggtggcgacatatccttttttctttttaaaagtattttactgatgtgaaatatacttccataatgtgcacactgcaaacatgtatagcttaatgaattcctacaaacaaaacatacatgtgtattcagcatctagatcaggaagcagaatattctccctgaagtccccttggtattcccttacagttacatcccatccccagtggataaccattatcctgtctgcttttagcttagatttgaagcagtgctttttaactttttaaaggttcttttgatgacaatttcatgcctaaaataatatagtactaataataacaacactttgagtgcttactgctgtctctgaagagcttgtacttttgtgtacattagtttttattacagtattgggcatgagacttatcttcaaatatttgaggtgatcaagggaaaggattatactttatctgtaaaagaaaaaaaacaaaacaaaacaccccacaacccaacaactacaaaatcattaagaagatgttatagggagacgggaaaacccaagcaaaagctcttaacctataaagtaataaactcttgattaccagaggtgtgcgaccggaggccctcacactgcctaccaggaatgctgggaagataactcttgcatgaccttgacatgaattagatcatttccaagggtcagatacattgcacagtggtgcaaatatccacatgcaaacttgccattgttttgtcgctgaatgccccaagtccccaagactaaactaaatatgaacaaagttttgtttttcaatcagttttttttttttttgctgtctccatcccacccgaccccagctgttagcctacagatacaaagcatactatctcaaatgcatgcctatcaaataactgaaggccatgaatggcaacagcaaactggaagaggtggctgagagtggcagcgaccaaggccacaatgttctgcccttgttaatgtgacctcaggggcagaggatgacctgactggtttttgagagtcaaaatagaaaaatcctcaggggtatatacaatgcagtggcagaggggccaggttctgcgggagagcagaggtactgttaaaggagttataggagctgtaacatgaattctgagccagcttagaccacagataacacatcctgtctttctagaccttgcacagaagtagcacaagagcatgaagtgctctccctgtggggttcccaggaatcgaagcagtctgagccgggctgccaccagggtatggggaggagggacactcacttgttgcagtgctgtttgaggtgtttcttatagccatcatcatgcaagaccacctcggggttgcaggtggctagccaatctgcatcctttagctctgggattagcaactggttcttcgtcttcttccccttcctccctctggggactggggcagataagcctgaaacagaaagacagcatagggcaagtggatagccaaggggggtgttacacacgggttttagaagagctgggctggggtttgttagaacagagttgggctgtgctctggatggcagaccctactccttagcccacaggtggtggtggtaggaaggaaggccatgcacttggtctcctccttagtaaacaaataaactccaggaccatttagtttgtcagtaagatttcccaagtaccctgtgaggattaagaaaggtgtaacataacctgtgccctttgggaacttacaacctggctgggagaaaaggaacatttgacctaaaacttcaaggggagccttagccaaggatagggaaggaatgtagcacaagaaaaggcacagacagaggtgggacagggacaggatggtgaaatgcaaaaggcaagtcactgtgcatccctaattcagagggggagtctgtgtgagactcaggttagtgggcaggaccagatgtgggaaactttaagagggtccagttgtacttcaacaaaatatcacaggtaacactgggagattctgaggcagaaacgaaagcaacatcttttcccactggtaacattctgaaaaacacccgagaaagagaagtcccccaaagcacagcaatacggccccgcagaggaagaggggatgaagtgcatgggaatcgtgcttcttaggcatggccctgccacctctcacctgagtggttctggagggtctgggcttgcccatctttggtaggtgtgatcagttcccaaatgaaactcttgatcttctcgtcccccttataatgcttgacacagtacaccaggagggcacggcaaatcatctccatgtccttctcgttcagatgccacttgaatcggccatgagtcaggatgtccttccaccggccccagctgacagtggacatacagacaggtgttggagggagaatggaccaggccatgcaggcagcctccccacaggaggagaaacaagagccatacatgctttttgttctctgtaggtctgttaatcatcccaagggctttgtcccgaaaggcctttgaggaccacctgactgtagcacaccgaatatcactaaagtgacctggacgttggacactgagagcttcatatggccactacaatgttaaaaagggagggaccaaactactgggagcagggaataaatttggaatcaaaaagagtccaacagcactattcaaaagcaatgatgagctcatggcagctgaacctttgatttctaccagagccaaagccctgcacgaatcatgccttggcgataacatgtgttgtgtggactccttgtatatccttgcggggtgggaggaagcaggaaatcagtaccagacagcaaattaggaccagagatttgttgtgacaggcatatgagaaaatcatggcatgtctgcattgtggttgcggagcatacggtgactgagacggattctgggcagaaggcacagttctctcttgctccaacagatccccctttgccctataattccaaaggtgactggagagacatcctagacaaatctcagggactgaaaaacagaggggaacaaacaacaataacaacaaaactaagcagagccaatacccacccaaagatgagcaggttcttctctacccggaagcactccgctcggaggtagcgcctggctttgtcattgaggcgcctggatctcgtgggcctttcgtctgagtcgctgtctaactctgaaaactccatgagctcgtcttcctcaaacgagttgtagtgtttggtctgctttctcacgcgaggtcggtcgatcactaagctttcctagaaatggagaggactactgggaagaaagtcctcttttctctactcctttcacaaagcataagtgtatcctcaggacacatttgggatagaaccatgccccgtctcatcctccagcacgaagggctattcccagcacacctgctgtctccatgaccacaggacaagcagagaagattctctgggacttgctcaagttgatgtgctccctggcccccagtgctgcttgtcaccatctgttgtttctgcagtcattctacccggggtgtgggcaggcaaggcccccccccagtgaccaaagtggtgtcggctctagccaagaaagactggagtagtgaagacccagctgttctgcccagcatgcagagagcagtctgcactctggagacaagacaagctagagaattccatctgctcagcaactttctgaagacaaacgcatattcctgctttatttatctgccttcgactggttctatccactaaccttttgcctttcactgacaataccatctccagctcaggagcctcggtcattctgatggttcccctggctatgtgtcttctctagtctccattgcttcctgctcctcactccttcccccatacctcttccccaagccaggccagcctcctgactactcctccacacagcccagataacaaatgtcgtgttatccctgctctgatcaccgtgcttcccaacacggaaggctccaactgcttctgcctggctacagggccacagtgctttctccccttgcttggacccagtgtcctgcacacacagtagcttcttgattgcgacactgtgaaacacttagaacaggttactaaaggggactgcaggatcttcttaaaagaggaaaatcagcatttctatttataggagaaaagagggtggattaagcaacctgtggtcgttctggctgggtgctggttactgaattagctagctacaagcagggactgtctcctggctttgtggaaccatgagagttcaatactcacctgagaagacactcatcctgaagtgaggtgacagggtcagagatgaaggacgggaaatcaacatttaaggggtgcctcacagtgggctgggcactggtgccagttatacccacaaatgttaccttgtaaccccacagtgtgggcctgaccacctcctcttctactaatctcagcgggggtcaaaagcttcatccgaaggcatactctggtttcactctcaagtccattctctttctcatgttcagaattaagaaaacatgagacactgaaagaatggaggtaaagccaacaaacttttgtcatgctttttccctctattatgtgtgaagtttctctcacagaaagtgttgaaatacaaataaaatagtcacatgccagggatagaatgttggtttgaggcagaggcctgaacttgacctgtgtatccagttccagttctaattgccttcatctaatttcccaggtgcccaacagactgaatggccatttaaaaatgacaacagttaagatttattgagtgatgtctatgtgccaggcatattttaagcatggtacaaataccatttaagaaccaagactcaagagtaaataatgacttgagctgtgtaggaatttattgtcatgtatgacataagtgaatgttccatggaataaaatattattttgctgtaccttttcattctttgcttcagtgtctagttcagctattttagcccatttctgccaaaagttaggatcatctaaggaaatatctgttctgtttcctgaagccacaaagctagcctgtgaagaagacaagaattaataaactgtgcttgaacacaatacaaactaataaaacaccagtgttacttcaagagaaacctaagtatattatctatttgcattcaaaatcaaacccttaacagagcttccaaaatgaattgaaaatctcaaggctattctttttttaccttttattttaaaaattgggtgaggaaatcataatttcaactgaagggatcatttttttttggagcttaagcttggaagcaggaaggcaaaccccggaagacaatggcaatgtgacacttggtgtctagtttcctatgaaagagttaacacttaaaacttttctagatttttctttcagtgcaacagttaccaaatgtctgctatggaaaaggtattaggctgggcagtatgaggtgtagagacaagggatggttcacccatatcctccttataaaacactgaacgtcccactaaaaaactttcaggtgtcaccaaacaggagatttaatcaaacaggtcacaaagctcacacaggaatcagcagtggttgtggctagggaaacctgagagtgatctgctaagttttaaatccagtggcctaaacagcagagaaaagaggcacccagactagaagctgggaattttacgtaaaatctctttcccattaaacaaacaaacaaattgcttgagtttggggaatggagtgttcactggagcttccactctctatcagtgatcaagaagtgctctacaagggaatcaagatgtccactggaaggtttcagagcagtccttgcaaacagagccaactgagaataggagtgtttattctgtctgttaaagatcagctctcaaaggtgaggagtggtattttcttggtatagtccctgactccctattcagacttccttcctctaaggatctatatctttagatagtcacgcagactaaatgtgcagccaatttctaggatttgcattcagagaaacagaagccctgctaatgggtttcagagaataaacatttttttttctctcccacccccaacagctctggagagaaggccctgtaccttggcaaaagtggaccctttcccctcagactggatggtgatggtgtgcgttcgcctctgcagaatctggtctatgtcttcttcacagaacttggagccttcatcttcttcatccattaaggctccataagcacctttccggagtaggtcctccacctccatttttgagagctgctgtacctggacaggtcaccaaaggctactcacaaagtggaaaatgtataggagaaaaacagcctcaaatctggtttttgtgattcagtgcatagttcctccatgaactacatgttagaacaaaggacgtgggcaacaaacttcagctagtgaaatcccagatgcgatactctggggagggcaggcagacagtcctctataggcagctctgaaataaagctcagcacatgatccaaggtccctaacattcttcaggatgttggttattatcagatgtcacaagccactataactatgcatcattgaagatggtacttttgacatctttatattttagttagagcttgtatctttaaaaacctccagatgtaccaaacaagcagaagaacaatgatttattcattattaaataaatatgtatattagtattgtaaatgaggtcatttctcaactaaaaaaaaaatgatcccatgataaatgtgatcttctcaaaaaaaacaggaaatggggtcccaaacacccttttctggttctaattaagaatctggttctctttatatcaatcacaagagggaattccatgactctctgcatgactaacttgaagtattatacttagcaacatatgcatagctaagaggatatggaacatctggactaaagacaactcatttagaaggtttaagcatccaatctttgatgccctgagcccagagattaaggaaatattctgctttgtttgcctatactttaagatactttaggacaatttaagaatcttagctgtaattcttatgcccccaaagggggaaaaatattttaactgccttattttaagctgctaatttattcattcatttactgaccatccagcactttatgtttttaatatgccgagcactgttaggggccgaggggacatagataaaattggtcccagtacactctcaaagctcaaagtctgaggtatgagataaggcacagtaacaaatacaatgttaagatctactggcttctaacgggcacagttaaaaactctgtttactgaaatgttacaccaagctgggcaatcctacctcataactgcttctacggatttcctttaaccacccagaaaacacagacacctgactcttaacgatgccctgttgtagggaattacccaataatgatgtgagggctggctcaatgcagcgaaagtgaacccttaaacagctgtaagaagagaagcctgtctgggctgtgcgaccaatgttccttaagactccagagcaggcccatcacactcaccccattggtgccgccctttcggttgatgtcctgaagaacagccttgtccagccccagctttaggctggccttgtcaaacatctcgcgctcgtaggaatttcgagtgatgaggcgatacaccttcacagctttgctctggcctatgcggtgacatcgggcctgagcctgggaagaagaagagtcatatgcatcacgtcaccgtatgtataaacggcagcaaccctgggaataggggagtgcttaaatgtcatgtggtgtgagtggccaactctcggttacaagtaacaggactgatttcagaacagaatttatacccaaaggttggctgccaccctccgtggccactcatttcttctcccattgtgtactgactactgcgtgccagggataaagcaatgagaaggacatggtgtcccatcctgtgcccccgccctgctgtggtctgtgcaaggcaacttgtgagtggcacacattcccaggatgctgtcctgtcctcttggaagatatgcttcagagctggtagcactgaaaatttatttttaaaattttgctactgaaattttcaaacatagatcaaaatatagggaagtataatgacctcttacggacaatctcgtttatttttaccacactccaccctcccagattgttaggaagtaaataaatcctaagcatcatactgtttcattcttacatatttcaatacacatttctaaagatacaaactcttgtaaaatatatattattatcattgtcacacttaaaaacaactgcatttctgctgtgtcactgaacaggtacctttatttcctgtattttctctaaactaggagttctaccttggaacctgatcagcttaagatttgagcatctgaatgtacaccaagaggcagatggtatctggtcatctttcttttgaattgatgatcattgcctagatctgttaattcatcaggggctaccctaatgtacagttcatataggagggacaagctaaatatttgattctctttatttaatcagtttccaaaataacatcccaaaaagtgaccaatgaaattttttttattacttctttatgggatacaatgaaggcatgcacttaaatatatctgccatgttttactgcactgcagttattattcttattgctgttcacatttggctcatgggagcctctctaagttggctcctgagttccttcaacatgacctagtcaaatgtggaaaaaaggaagacgagaatcaactctgcagtatttgaatggactgaaggtatcagtatgaactcatggttaggtgtatatgtatatatacacacatatacatacacatactcacacagatatagaaataggtatggatatgtgtacatttatgtttgtatgttatatcaaagactggtagtctttcaatagttcccttgctttcaacatattccacactcctcttgtacatttcctgtccagacctggcttcagccattttgtttccagaagtcctagtctcttttagcgggaatgttttttctccctgagtaagcaagcagaggggtgattactgacactgagaggaagaggtggccatgccatgtgagtgagccctgcaggtatcactggacaccccaggtccttccttatcttggcccagagcagtaagacatgtggcccttgctcctctgtgagttagtggcagagcaagtctggagccttggacttctgctcctgccccgtgatcttgatcctggagtccagaattgcaagcaatgggtcccctgtgtcagaggccaggctgtttgagttggatttgaagttactgggcccagagaaaggggtaagtctaagcaggaatcctatgtttgcccataagggactcacccagtgccagaatccctggatatggaagcccccacccatgccctgcccacattcttcccctaacctcatggctgaaaatgacaccagaattcctatacttagtactaaagcggcccaaacactaagaagcccagtaagtactgggacagaagagaggccactggggcgggggtacaggaaatggccatcaaagcagggctaaaggagggtggatcccaggcacctcctgccacttggcccactgtgttacagaggtcctccttgcaataagaaagcttgaagttcatcttggtgcccaaaatttgcatatttctgtgatacgatttggctgtgtcaccatccaaatctcaacttgaatttatctcccagaattcccatgtgttgtgggagggagccagcggggaggtaactgaatcacgggggccagtctttccagtgctattctagtgatagttaatgagatctgatgtgtttatcagggatttctacttttgcttcttcctcatttttctcttgccgccgccatgtaagaacagcctttcgcctcttgccatgattctgaggcctccccagccatgtggaactgtaagtccaattaaacctttttttgttcccagttttggatatgcctttattagcagtatgaaaatgaactaatacagtaaattggtaccagtaaagcagggcgttgctgaaaagatacccgaaaacgcggaagcgactttggaactgggtaataggcagaggttggaacagtttggaaggttcagaagaagataaaatgtgggaaagcttggaacctcctacagacttgttcaatggctttgcccaaaatgctggcagagatatggacaataaggtccaggctgaagtggtctcagaaggagatgaggaacttgttgggaactagagcaaacgtgacttttgttacatttaagcaatgagaccagtggcatttgcccctgccctcgagatttgcggaactttgaacttgagaaggatgatttagggtatctggtgggagaaatttctaagcagcaaagcattcaaggggtgacttaggttctgttaaaaacattcagttttataagggaaggaaagaataaaaatttggaaaatttgcagcctgactatgcgatagaaaagaaaaatcaattttctggggagaaattcaagctggctacagaaatttgcataagtaacaagaagcctaatgttaatccccaagagcatgtggaaagtctttaggccatgtcagagaccttcatggcagcccctcccatcacaggctcggaggcctaggaggaaaaagtggttttgtgggctgggcccagggtccctgtgctgtgtgcagcctagggacttgttgccctgtcccaactgttccagccatggctgaaaggggccaatgtacagctcaggctgtggcttcagagggtgaaagcaccaaaccttggcagcttccacgtggtgttgagcctgagggtgcacagaagtcaagaattgagatttgggaacctccacttaaattttagatgtatgcaaatgcctggatgtccaagcaaaagtttgctgcagaggtggggtcctcatggagaacctctgctagagcagtgcggaagggaaatgtggggtcggagcccccacacagagtccctacttggtcactggctagtggagctgtgagaagaggggcaccatcctccagacccagaactgtagatccactgacagttcgcactgtgtgcctggagaagccacagacactcaatgccagcccaagaaagctgctgggggagggaggctgtaccctgcaaaggcacaggtgtggagctgcccaagactacctcttgcatcagcatgacctgaatgagagacctgaagtcaaaggagatcattttggagccttaaaatttcaatgctccggtggattttggacttccatgggccccctttgttttggccaatttctcccatttggaatggctgtatttacccaatacctgtatccaaatcatatctagaaagtaattaacttgcttttgattttacaggctcataggcagaagggacttgccttgtctcagatgagactttggactgtggacttttgggttaatgctgaatgagttaagactttcggggactgttgggaaggcatgaaatgtgaagacatgagatttggaggggccaggggcagagtgatatgatttggctgtgtccccatccaaatatcaacttgaattgtatctcccagaattcccacactgtgggagggactcagcagggaggtaactgaatcatgggggctggtcttttccatgcaattctcacgatagttaatgagtctcatgagatctgatgggctcatcaggggtttctgcttttgcttcttcctcattttctcttgccgcttccatgtaagaagagcctttcgcctcccgccatgattctgagtcctccccatccatgtggaactgtacgtccaattaaacttctttttcgtcccagtccccggtatgtctttatcagcagtgtgaaaatgaaccaatacatcctggtttaccaagttgttcttgggggcaggagggaaggcagaacttgttctccactgtcactttcttagactcaacaatcctggtcacttccggggagacccagaccccactgaggaaggagcacatagctggcaggcaagagcttatgtgtgaggccaccaagcatgggcaacagaacagaccctggggtctctgtgcacagcagggccaccaggaagaccagagcaaaggtcttcatagcatgggaaaaactaacttttcctctctcttgccaggctgcagggcaagtggctaagaaacagtccagccatagacaggggtagaaaacttacagacaacaatctggataccctagaggtggtccctgctactagggatgatcatggtttctagtgcctactcagtgggcaaatataggaagtgtttgtgtgtgtagagtgtatataaacatatgcatatataagacaaaatacatcatgaggtcatactgatatttttagttcaaattatgattgaagaattttagtttcatcaacctcacatctgtatttctttaatcatgttgaaaaactcaattttcaaccacatcaatatcagtactcatttgatttgtcccacaatataacattttcagaaaaccaataccattacaactcactcaaaacataattaccaaaaaatttcaagatttttctctccccagccacttagggatatatcctgctaagtatgtatagtgttttaaatacacacttgaaagtaggtttattttctgtagttgcaaggttagcaatcctgaaactactttctgtttaatctaggtttcagcaaatgagtaaagataccgggggtagcaggagtaagggctttcactgttggagaaggaaattataaatatggaaaggaggaaaactaaaataaactctgtggtgctagaatgaattggaggtatcagtattaactcatggttaggtgtacatgtgtatttatatacacacatacatatacataaaggtacagaaatagatacggatatgcatgtttacgtatgcatttgtgtctatacacacatatacaaatgaatgcatatatttacacatatgcatatttatagtctctctttctgtgtgtattccagctatgtccactgagagggcctagaagaaacatcattgcagtagcaatgaacacacccaactcctgaatcttgattgctaaaaaccattacctatacaacagagccacagtgtgctagagaaatggctaactgtagttagggctgtggtagagaaagtatagactaagcctgaaacatattactgtgtcagatgtaagaaattactcaaagaacgagggagacatatgagaataacacttaaagctcgaagagactcccactggctaagtctagaactatatgaacagaacatcgaaataaatatagtaacagattataactcactaaataaaaaaagaacccatgtattcatattgacataaaataaataaatgggagaaaaagggaacactcttccttatagtagaatgctaactaaccagtgcagagcgacagttagaaaatcatcactttgtaaccatcatagtgatgactgattcagccaaaaataatcaatggatgctaaaaccaatgggtgatactttgatgaggaacaggtacagttccaatttatttctccaaaattacttattattttcaaagggaaaaacagaaactttataagtggagaaatcggacagatatcactgtactaagtgatcaaagttaccatcatcagacaaatggacaccatgttattcctgatgtgatatattgagatggctgtgtcagttctgtagtagtactaaacctagatccaatcctgaggaaatacagacaaatccaaacggagggacaacctacaaaaaaactggccagtactcttcaaaaacttgaaggtcataaaataaaaagaaaaactgaggaactgatccagattaactaagactaaagggacatgacagctaaaggtaatgggtgaccctggattgaatcctggactggggaaatgacagctataaaatatgttgaaacaaatgataagacttgaatatgaactgtggattggagaatagtatttttatatcttgattctgagaactgaactgtgaatatacaagagaaagtccttgtacttagtgaaatacacactgaaagtatttaggggacaagggggtacaatgcctgcaacttactctcaaatagctcagacaaaaagtgatgtgtgtctatgcatgtactcagagaaagaaagggacagagacacaaaggagagagtgagaaagggcaaaaatgatagagtcgaggcaaaatgtaaacacagctggtgaatctggataaagggtacactggagttgcaaaatgaaattatatagaaataaaaatgtataaacatatgaaatacagacccttgaaataatccttttctgtgagttataagctattcacttgatacacagctagattcaattgtttcattttgcttttgagttttaggaattgatgtttccccctattaatttaaccacactgaagcaggtcgtgaagaaaataactaaactaagcaactttggcaaatagtattctgattatatactgtaatactaaagaccaaaaaacccactatagaccaacattatattctggtaaatgtatttttcacaaaatatgggttagcaattctaaaactacttgatgtgtatactaggatggaataaatgaataaatatactgtgttatgataacaaggtccaggcttcatcctgccagagaaagaagttacaaataaggaagaggaggagactataatgaaccctgtgatgctgcactgtaattagaaaattcactatggatgaatatatacagaataaatatagctgtgtggtatgagtgcttgcttaagtatgcatacatctgtttcctagctccatgtgcacagagggtctagaagcaataacaatctagtagcagtgggcatacctagtagccagagtttggtttctaaatgctgttctcaagtaaaagaaagcaaggatcgttggagaatggtcaattccaacgtgggggcacgaaaaatgtaacatggacttgaaccgtaaggaagcactcaaaaaacaatgggagcatgtcaaaaaaacacagaagccaatgtaaaggagctaccaacggccaaatctggacaacctgaaaacaaaataaatagagtaatggattataaaataaaacaaaatccacaagtcaatactgatataaataaatgggagacaaaggacaacttcgttataatagaattcttactaataaatgtagaagggatgatgagaatagaaaactaccattagctaaacaccatggtaataatttactgaaagcaagaaccattgatggaagctaaaattaatggacagaagtaggatgaaaaacaggatagagtctcaaaatattcactcagaagatactaatttttagagataaatacagttattttatggtggagaaacttggcagatggcacgttaaccaagtaatcaaagttacatcacgagtaataagatgtattcatatcacgcatcccctgatacaatgcactgaggaggacataatatgatttctatggtactcttgcctaaaatgcataacctcgtatctcaccataagaaaacatcaggcaaatacagactgagaacagtccacaaaacaactggtcagtacccttcaaaagtgtcaaggtcatgaaagataaggaaagacaaaggaattgtcacagactgcagaaggttagggagtcacaacttctaaatggaatgtggatactgggccagaaaaaaaatatttctaggaaactgaaggaatgaatatgaataaggtctgtagattagttaaagagtatcatatcaatgttgctttcttggtttcaatcattatactacggttatataaaatgtcaacattaagggaagctgggtgaactgtacattggaattctacataatttttgcaacttttaaaaaaggttaaaaaaattaattttgttttaataatgaagtaaaatgcttaaaatggttccaaagtcaaatacacaaaacagcatatttggaaaaaccagcttctttccctgtcccttccatcctgttctctaaaggtaaccatttaaaaacaaagtttgtaggccgggcgtggtgggtcacgactgtaatcccagcactttgggaggctgaggtgggtggatcacaaggtcaggagttcaagaccagcctggccaacatggtgaaaccctgtctctactaaaaatacaaaattagctgggcgtggtggcgcgtgcctgtaattccaactacttcggaggctgaggcaggagaattgcttgaacccaggaggtggaggttgcagtgagccgaggttgcgtcactgcactccagcctgggtaacacagcaagactccatcccaaaaaaacaaaaacaaaaacacacacagtttgttttagttttacccttggtagggaagggacagacaaagacacacagccttttaagataaatgctagcatacagtacaaattttttccaccttattttttttccccgcttaacaatatatccagggtacaatccagggtatagcaggatatagtgatagtcttcattcttttttcaaagctgaatatattacagtttattcaattagtcatctattgctgaacaattcagttgtgtagtctttagctattataattcgttgctggaccttctttctgtatctttagcggtagcaaatctctgctactgggaggtttgatgaatgattctgcaaattaaggaagtgatcatggtgaacaatatggtttatgagaccttcaagatagtaatcttatacggcccttaagtactgaccctgatttctttttctggctcatatggtgttgagggtaaattacaagagggagctgaaaagttctgagcaaaagatctgatggaggagccctgcagacactgctaatggccttcgtagcatccatctctttcttgctcactgccagaaccctgactcttgtacagggcagcaacattttcaaccgaaactactcccagcctcccagggatggccaggtaacacagtcctagacaatgaggtgtaacagaacctcctgaagatatgtgccaaagttctgctttcctgtaaaaaccaacatgcctgctttccttatttttcctttctgagatggaaccaagaggctgtaaaccacacatactgaggccagtggagcagaaagacaggaggaacccgggactccgatgacactatgatgtcacctcactagtcctcaactgcctacctctggacttgttaactgagaaaaataaacccctgtttgggagagccgaggccacaagcagctaaattacatagaaataaacatgttctcccccaagatgacttacctgaaggacaacaggataagtcccatcacatttaagagactcatcattttacagtcaaatctcaaaccattctttattttcctaagagaactcaataaaaaaaaacatgagatagagaaagaaacattcagaactagggccaggaactcagatgaagtccaagggaaatgcatcagcaaaggtatacatataaaaacctttggagtaaaacacaactagggggcagtggtgctataatcccccagccctaatccctggagaaaattatagtgctctaattatagtgctcacaatttcttctttattttttaatacatttggggtggacaaaagccaaagagaaatgaataacgacgttctgacaatgaaaaaaaaaaaaaaaaaaaaaaaaaggctgggtgttgtggctctcgcccatcttcccagcaccttgggagtctgaggcaggactgcttgaggccaggggtttgagaccagcctgggctgtcaacataacaagaccctctctggggttaaatctgtcagataagtcagtcaagaactagctgagaacaggaaggacagatgaattcacagaatgggaaaggggtgcttttgggcaacagaaaggagttaaaaaaaaaaaaaaaagaggacattgacaaggagaggcagcggcgtactcaaaaggaacgtgactcattctatttaggactggtgctgtgtaataagtgcctgtcccatcctgtgcttcagacgtgccgcctattcacatcccactctacatggtcatactctttgttttgtctggaatattcttccttcttatctcataattttagatccttttcattatttctgctcaaatgtcatcttcttaaagaagtcttcctagaccactctttctaaatcagggcaaccaactcctatcattcttttttttttttttttgggagatggagttttgctcttgttgcccaggctggagtgcaatggcatgatcttggctcagtgcaacctccacctcccaggttcaagcgattctcctgcctcagcctcccaagtagctgggattacaggtgcccatcccgacgcctggctaatttttgtatttttagtagagacagcatttcacgatattggccaggctggtcttgaactcctgacctcaggtgatctgcccgcctcggcctcccaaagtgctgggattacaggcatgagccaccgcgcccagccccaacttccatcattcttatccccttattttattttctttgcagtaaatactgcttatctgtaattatcttatttttcctcatttattgtctgcctatcctactgaaataaaactgtcagtctagctcaccagtgtctctccaatactttaagtaacacctggcatgtcccagtgatcaagagatagtcactgaataaatgactacatagtatagtatttgtgtatacatttacaaattattactttctcatagcaaagaagactcaacaggtgcaatcctccaaactccagacacacgtactgtcaagaaacaggggatgtaggtggggcgtggtggctcatgcctgtaatctcagcacttcgggaggctgaggtgggtggatcacttgagctcaggagttcaagaccagcctaggtaacatgttgaaacctcttctctacaaaaattacaaaaattagccaggcatggggctcatgactataactccagctattcaggaggctgaggtgggtggaggctgcggtgaactgacttcgagccactgcactctagcctggataacatagcgagatcctgtcttctgaaaacataaaattaggtaagaaatagggggtgcaagcaatgtggtggcagcagaggaagaggcacaggggtccaatacctcttcccctcggagcagtgtgggagtttcctgagtcctgcttctggcgattgtggaaagggcctgtctcctcactctggactcccaactgacttccaaaatcctgcagacatgcagcagctgcattatcttgtggctgtgctcttggccaggacatctgctcccacactttctgaattctgccttcagggaccttagcagcaggaaggacgcagaactgtgcagcccaccgttgttatcttgaaccctcttcaaccctaaggatctcttgcctccagatgcaaaaagtcccccagagaataagaagcagaagtatcacagaacaatggaagaggaaggtttgtggtctctgaggggagcatgatagcatgttattcccaagaggtctgcctttgccttcaggggtagcagcaacagtggcctactcctaagaagaaagaagacaaaaacccagtttttcctttgtctttccttctcaggctactgttatcgtcctgtgccacttcttaaccttaggtgttatgggaaacctagacaacacttgctgctgctgatgtgccaggactaaattagagcctctgtcttctaaatgatggtgagaaaaggcaaactgataaccttcaattttgtacacacattgatgcgaatacagacatattcaaggtttgagagagggtgtggcacttacctgactctagataagatctccccattaaggggacgtaaaaattggttttccttttaatagtccagataaaacagtaatattgctaagatctctcagtgctaactttaatctcttttgttattcctaagtagtacccagtttctatcctggatcctaatgaacctgtgccttcattttctggaaagcaagaggaggacaggaggatttgggaagaggaacacaatgatgtcagcgtcccagcctccacactctctctggagtaaatattctatatttatagcacgtgggtgcaagggcaaatgccaaggggcgtgggaatgtgtgtgtttgtgtggggagagtgcatcattctgtggacagtctccagccctcttgcttttggaaagccctcttgctctcttcctcatcacaccaagcaagcaagaaccttgctccatctctgtgggagacacagaatttggaccttcctctctctatcacatctttttatagcccaccagtcccactaactaatagccactcttctagtcccctgtcctaaaactgctctacatttctcaattccttcatctctacctagactggctagactttaaaaaaaaaaaaaggatgattccttccgagttgtacacatgttctctctcacacagtaaccttttgctgcattctccttacgaactcccaccctgcatcttccaccttggatcttcctcagtgctggtcttcttcgtttcttcattcaggctgagcattagaggaagttcagaaactgactcaacacactagtaaagttcacactatccaatttcagtttggacttcactgctattccttaattcatctcttgccagctccccagcagtggacattgagaacagctactccaaagcttctcccttcatccaagacccttattctggacagtcccacccaacttccctggttgctacacatataaatcagtcacctcagatgactttgccttctccactaggtttgactattcacgttcttgcttttcccatggcattgcacctattcaactggtaatgtgtagacttcacctaggtgaagcatggtcattccaaaatgtttgcctctggccatgagctgttgccagccccatgcttccactgatcctcctggatatcgcttcaggcatgtccagccgaggtgtcctcaaactggccattcaactttggtttcctgtgccactattcttccagctgccatgcctcacagtcaggtgagcatcacaaagaagccgagaactttgtaactgtcaaggacttaagaaatcatgttttggggttggcaaaaatctgaaaagggcctgatagtaaatattttaggttttgttggctatgaggtctctgttgcaactactcaattctgccactgtaacatgaaagcagccacagattatatacttacaaacgggtgtgattatattccaataaaactatttttaaaaacaggcagcaggccaaaaggcaatcattttccaccccttaatctgtataattgtcgtaagtaggttcttgatagtgagctgatcaaatattagtttttgcttattattattttagtgttgagtgtgttactcctttaaaaatgggttattcattacatccagcaactcatattcagccatcttttcaccagtagaaagatggtaagctagttataatcactggttttctttgagatcactggttttctttgaggttgcatgttgaacatagtttactttatgatgtataccatgaaatattttcagtttttttttttttgagaccgagtctcgctctgttgcccaggctggagtgcagtggcacaatctcggctcactgcaagctccgcctcgtgggttcatgccattctcctgccttagtctcccgagtagctgggattacaggcacccaccacgcctggctaatttttttttgtatttttagtagagacggggtttcactgtgttagtcaggatggtctcaatctcctgaccttgtgatccgcctgccttggcttcccaaagtgctgggattacaggcataagccaccgtgcccggccattattttcagagttttaaccatcactaacttaatttaaagcactagttttcaactagtaggctgctttcttcaaacacaagtttatgtggaaactcattaaatgaaaaagacaaagggccgggtgcagtggctgacacctctaatcccaccactttgggaggccgaggcgggcggatcacctgaggtcaggagttcaagaccggcatgcccaacatagcaaaatcccatctttactaaaaatacaaaaattagccaggcgtggtggcaggcccctgtaatcccagctacgcaggaggctgaggcaagaggcaagagaatcgcttgaacctggcaggcagaggttgcagtgagctgagattgccgcactgcattccaccctgggggaatggagtgagactctgtctcaaaaaaaaaaaaaaaagaaaggaatagacaaagcagcaactctgtaggagtgggtgggtagagaagaagcccagacacccattggcttagtgccctcttccctgcatcccttctcttgcagtatcccctagagtacctcttgaatcctgtcaaacagcagcctccaaacttcttttgatcaatcacctgtattatgaaaaaggttttgagccacccacccaccttcttcaccacatacccataatcctagtgttagtaaatatctcaagatatatgcgatatacacttaagatgaagttcttcattaatgataatggctgtaaatctatattccatattgtcttattgacaagttagaatctttttggctgacttcgcgtcccatatagttagaatgccattgtttttactttgaaacagggttgatgaagaactccaaactggaccctgccattttcttgcttgtttatgttagctttcaaaaaatatatcaactccaatctttgcagtaatcttttaaagccaccggttatttagtttggctaaaaccagaaaatagaatccataaagccacttaactggacacatataaactctaatgtgttgcactgtgtggagaacaaaggaactagtgaggctgccactgttgcccctgccacaccatggaactttcccacccctctgggttaactcgtttactgtacatgacacatgaccatcttaaccaacaaactgagtgaaaatgcccgaatcgtctacatatcaagaattagagcattagtcaagattagtatctttatttctgataataataataattagtagttctagtctatatctggaggctaccactgtgaaacatcatttgatttaacggaaagaaccacactctctaattagttggaagggtcgacatttacttttcattcagtttcaccccctgaccaaggccctaagcctgtcatccagctgacaccatagcatagagcatcacggatgctctgtagccaagccaggccctatcatgatgttctgggatccagggcagctaaggtaaacagcaatcatcctagtggttacctgcaagtcattttgtgggttccagtcagaatcaaatatgatgcaggtatcagcagctgtgagattgatccccaggcctcccgctctggtgcacagaagaaagacaaagcggtctgaatctggcttacagaaccggtcgatggctgcctggcgcaggtttccccgtactcgcccatcaattcgctcataggtgtatctgaggggacccaaatgaacgaaagcccaggcgttaatcatgacttcaatggagaacagcacaaaatgcaggaagctgtcgactgatggccttaaatccctcacttctaaatttggaccaaatgacagcagtctagaaggaatcctgccccctacatatgcagcagggcagacacttaaaactgtattgcaaaatgcccccctctcaaaacagaacaaaacaaaaaaacaaaacaaagcaaaaaaaaaccagctgtaaactaagaaggactagaagaattaaatcataaaataccgatccccatagcccaagcaacttattctctcaagtattcccagtttatacttaaatttaagcataagaccaggaaaaacaaacaaaagcctttcccatctactttgagtagtgctcacaaaaaggactcagagttttcatcagtttccagctactttagggtaaaccagaaatggtaagaagattaaactgtgaggcagtccttttatgtcacttctagcctaccaagttcctcaaagctttggaggtacacagcaaaacctccaagtttatagctgaaaccaaggtcttctggacagtagtacattgccaagcataaatcacaggaaaggtttttgaggtgtgtgtgtggggtgaaggaactgatgaatagttagaggaaaataaagtaggaaagtaaagctgagtatcattgagaaggcatacaactgtgtggaaaatcaagaaacaggggtggagtgcatggtagaggtaagggtaaaaggaaaaagaataagaaatgaaactgttaagggaacatattacccatgcccatctagagggaaaacagaagagacctttacgttggagatcatgggattaacacagaagatatagcagcaatctggacagctgctgggcgtcttattcttttcctatttacccctgacaacatatgaattaacaagggggatgttactctgggcccaattttgacccacaaacatgaactggttagtgaagcagaagtaataggaaacgtgtgagaaaagaaccaaatcaccccaaaccgacaacagccaagaccatgaatcctggcaaaatcctatcagcagcccagaatttgggaaatcagatctctaaaacttacataaataagcaggaagaaaataaggatagataacctaggggtagataattctgtgtgaggatggctttggaaaactaaatctggcaatatgatcttgacttccttgaagaaaagaaaaagccatgtaaagaaaccacccaaggaaatgtacatgaagaaacctgaccaactcagacttataagggacatgtataaagcaaagaaacaagtctgaaaatgctgtctcccttttataaagccacaatacaaccatacctaaaattaagggtacaattttttgtttcctctttatttaaaattataatacactcaagaataataaatgagaactacagcagcaaatgaaacaggcggtggtgataggattgtcatgaaggcagactaaaaagattttgtgtcatagacaaaggctaaggattagatgtctgaattctatagatttaattatcaccattattcctaacaaccacaataataatattagcagcaaattcttaagtgtcagttctgtgccaaaccctgtggtacatgcttggtacacatcattacatttaattctcacaatagtcctatgaggtagtttctattatcatcctcattttacacttaggaaacctaaaaacagaacaaaacaaaaattcatacaagtaacatatcttgctcagtcatctagctggttaagtgagttaaacccacatccatttgacttaaagctttcacactgtaccttacatttcaatgcagtaggacagaaaggttttcctaaacacttaagaagagaaatggagaatacataagggacactagtaaactttggaagcttgtaactctaacaggagatggaaacagaaactataactaggtatcaaaacatttttgataaatcagtgctcaggatctgtaacagttacagaagtttagccatgtatgtgatgcaatagaggaagcacaatacttggagtcaaaaacagggttgagattcaattaaagaacagccatttccccccctctaccctccaccaccaacacacatatgaatgattaatgctgcaggaaaagactccatgctctttgaaaaaacacccctagtcatcagagttagataccacatagatcagagtgaggctgggaattagcacagccttaagggggaggggaaatcaatacatagtgatgatacagctcagccatcacctagggaaaccgttcccataaaattagataagtgtttttgtgtattataatgtaacaacacttttagaacttttagaacaagatgaatggaataattctctatcacttgtttagttttgagggagtgctctcaaagaacacaaaacttaaaaaaaaattgaattatttgagctcctccctcacttttgagccagatcctctggccatgccctcattcctgtgtgagagtctggcatgaaattaaatgggaacaaaaccaaactgacagctggagaggcaaagaggctcaagaacaaagaaaaccttgagggctaataagtctgaatgaagaaatcagacatcataaaattttccacactgaacttcagcacagcaattaaccctctgtgacaactgtatttttaacaagatccctaggagttgatatggttcaaactgtaattctgagtcactatcaaatactatcaagtatcaacaagcagcaggtggcaccctggaaaaaacctctatgtgactggccaggagtagactgacatgtttttggcacaagaaatgttgactttagaaaggcctgaagggaaatgaacaactttctggtctcccagcaataatcaactggaaaacatgaagagttaatttaaaaaaagaaaaccaaaaaagcaaaacaaaacaaaaccaacaccaaaaaccattcacaacagttacaagcatataaaatacttaggatttaattcagtaagaaatatgaaggcttggtaacataacactaaggggccatgctttgttcaccattatgactgtaatacctacagaggttctagcacaatgcaaacactttacaaatatttactgagacaatagtgtatatgaaggacccaagttaagtgtagtgaaaagcatgttctttgattttgcaaagatgtcagtctaaaaaaataaagaaagaaagaaaaagaaaaaaaaaagctaaaaaaatcccaacacacgaatatatgtgtatatataaacatgtaaatgtgtatgtatgtatacatacatctatacatacacacacatttttctggagttaggggctggagcagacagagacagataaataagccaggtatggtggctcactcttgtaaccccagcaatttgggaggccaaggcgggaggatgacttgaggccaggagttcaagaagagcctgggcaacatagtgggacctcacctctacaaaaaagaaagaaaaatcagacaggcatggtggccaatgtgcctatcgtcctagctactcaggaggagtaggtgggaggattgcttgggcccatgagttcaaagttgcagtgagctatgatcacgccactgccctctagcttgggagacagagcaataccctgtctctaaatataaataaataaataaataaataattctgaagttcatctggaatattaaatatgcaaaggaataaaactactgatcaaaagactagaaaggctagacatttatccagtatacataatatctccctatatttcatagaattttatgagtcagggaaatagactattttactaaacagaaaattagaaaattcaatatatttggaaataaatgaaaataagacttcgattatatgccatttaccaaaattacagaagggctaaagacttaaatgaaaaaaaaatcaaataatccagttaaagattatgaatttaacatacacatttaattctttgatctctccaaacctctagtaaaatgacagtaaaggatgttttaaaaaggtataatcccttccccaattaaatccaccaaaagaacagaagtgataaaattctggcatctggaaagtcgtatttgatttgaagaaggcagaatcccaggcaagacacaacctaatttaatagtgcagaacacgtgacgggatcaaacattggtggcactaggtatccccgaaagcagggacgcagagtctaaaaacagggaaactggtggaatatttgctgaagtatttacttagcctctagatcacctaccccagccttgaagagggtaaaataaaagatcttgatcctctctactctagaagatactaaccacagttaaaagtgaatgtaccatgctgaaaaggggaaaagagacagagatagtgggagcccttactctttctcacccctcccccacaattagctctaaatacagtcaagtttccacctataggcaggggagagtaagaggaacaggacctcaaaatgctgatatagaagggtccccaatgaaaatggtccagccagatgcacagtgctcccatatggaaagtgaagtgcacagtcaacaagccttgctcacatactcagagcttctggttggctccacagtgcccccccatctgatggcctaagatatcagacatgaggctgatatgaaacacacagcctctgcttctggtaaggaggagcaaggtcctaacacaccaaccctctagcaaatgacaaattctggacaaactataaaaaccaaaatgaatgaacagaaaaacctacctgagggcactggcgagttaacaaaagcagacagatcttggagaagaatagaaatttgtggtttcagccagaggggaggccacaattatggtggcaaggtgttgatcagctgtaattgataaaagctgttgtctttctgacacacatcaggggaaggtacctagggcaactaagactgccagagagtgagaggggacccccagaaagcagagaaatagagatgggaaccccaaactctgggtataaactctgcccaagtttctggctgacttctgactcacacttgctcgggcctgattgtggtagtctgaaatgggaactactgtctaccagacacattgacagagtttgcactttgagcacaacctagttaactgcttccaaataaaacccatcaacatcttcagagcaatataacagaattctaaatctctagaacataatattcactagggctagggaaaaattcagttattctcattctcaagggaacaggcaattaacagatgtcaacgtcaaacctacaatgttataattcagacaagaactttaaagctgctattatgctgacgcttaatgaagtcaaggaatgttaagtaatgaataaaaagaaaagaaaactcagcagagaaacaaaacgttaataaacatagaaccaaatggaaattttagaactaataaataaagcatagagtgtgcttaataagcatgatggagatgataaagaaaagtcagtgaacttgaagacagataaaagagagagaaaaagggtttttaaaaaaacagagcccatggacttgtggggaattatctcaaggtcaaataaacaggtaattagtctcacaaataaccaagagaatggggcaaaaacaaaaaagaaattgaagaaataatgatcaaaagcttctcaaatttgatgaaagacatacatttacaaattcaagaagctcagtaagcaggatgaatcccaatgatcacagttaaactgctgaaaaccaaaaattaaaaagaaaatcttagaagtagccagaataaattaatgtattgcacacagggagcagcaatgtgaatgactgcagaacttttcataagaaaccacggggaccagggcacagtggactaacactgtaaagagctggagggggaagaaaaggaaaaaaaagtgaacctaaaattctaatatgaaagacagatacaaacaaatgggaaaaaatatgacttggagaaaacagatgaagataaaaaaattctatcctgataagccttagaaagacaggagaagacactgtacttgtgaaataaccagtgctattaaaaatggaaaaattacaaaaaatgttctgtgaaattaaaaaatataatgaaagataaagtcaagaaaattccccagcatctgaacttagatttcagatgggaaagatctatttagtatccagcaccaatgaagcagttcactgtaaaatttcataggactggggacaaagagaatacataaaaacttctaaaaagaacaaacataacacatacacagactaagaatcctacaggcttcgaacttctcaatggcaaccctggaagctagaagacagtggattaacaccttcaaaattctgtagggaaatgatttacaacctagaatctcaaatcctgcgaatagattccttaagaatgagagcagagtaaaacattttcagacaatgtctcaaaatttacttatcattcaccctttctcaggagctcctggaagaggtgctccaacatggaatccaccaacaagaagatctgatttaagaggaaaaaaaagaaagctgtcagcatgagaaacaaggcagatcacagctgacaactgtgtactctgtggggaacagcaacaggccagggaggaggaagtcaggaggccccagaaggtatggcctagagaagaggaaactgatgtgttggaacataaccagagatttagacaaccagggtaaagtttgctgctgaattataataggtgtatagaaaaataagcaatcaaaaagataatttttagtttcagagaaaataaaaactgtacaaaaatgaaaagtaaacagcacatgacataactcagctgtaatttcacattttcctaagtcataataaacaacaaatattaacctaactcaaagtattatgtggcatactgggaagatgagaggacaggaagttgtatacatgacggtatgaggagcagtgaaagaaggctaaacattcatcttccacagtgagaacggataatacctacaactgaaaaatatcaagaaattacaactaatatcattatttagatacagctataaataccaaaagaaatagcataaagagttgaaagtaaatgcttctgggatatgagaaactgggggaaggtagagagtgaattagcaaataatttttcattaagtgtaatagaatgatatggctctttaaattatgtgcacatacaactttaatgaaaataaaaactaaactaaaaagagaaaggcaatgataatattaaggccagaagaaccctgttggatgcagcttgggtgaagaagccataaacatgaaaagaagagctgggtatggtgatctatgcctataatccagctactcaggaggctgagatgggaggaccacttcagcctaggagtttgaggccacagtgaccgagccactgtacttcatcttaggtgacagagcgagacattgtctcagaaaaagaaaaaaaaatatatatatatatacacttcagaatatttatatgggtctcacggttaagatgagagagaagccttttaaagcacattaatttaagcttaagttcaggcctaaaaaaggatttaaagttgttttaagacaaagatttgactattataaaatttaggacatcaaaaaataaaataaatgaaaacccatactcataaataaaattaaagaacaaaaacaacactggggaaagtttttgcaacaaattcttataaataaacaaaaagtcaaagaccaagagaaaatgcatgaaaaacatgaatacacaatccacaaaaatgaaatataaataacaaatatgaaaaaatactcactctcattagtaatcacaattacaaattaaagagagaataattttgaattactggattagcaaagattaagaagtaaaaacaatattgatcagaatatggaaaaaagcattctcatatgatattttggaaaggaatataaataaaacactcttaactagagggcattttggaaatactgagtgtatcaaatgtttttaaaaatgtgcactgacatttatcctaaagaaataatgaaaacgttaagtactttaaagggatattcatttatagagtcccttaaaatgctgaaaaattggaaatgtttaaaatagagtatcacatagatcattaaaattttgttgtagaaaaataaagaaaaaaatttcataatatattaaataaaaaataagagttacaaagtgcaatgtagaacagcactgcaattcaaacaaacaataaagctaaacatatttatgcagaaaaaaacagactgagaagataacccccaagatgaatggggagttgtgcaggtggtagtgttacattatttccgcattttcaagagaaactacaatcttaagtaatttgaacacaaaatgagcaataaataataaagagaaaatagcataaaagagagctaaataaagacttctgtacttaccaaaagtctgttatatacacctttactcattttggggggttcttttttaaaaatctgcaaactaacagttgtacatattttaaagagtaagataatataagaagcaaatgctctggcaataggctcctaatctatagtgaattgaaagctacaaaactgctttgcaagttttgatttattcatgtaatacaagtctcaagaatcctttacatagaaatctctcctatagagctctgaggaattattttattgtctaatcagactttgaagaatcatttatgttacattaagtgtcagcatacccatagtttaatttgtcatttcttttaatcctcttgctataaagtacatgtaatgtacaagggcaaacagaatgttaaagaataagaacatctgttaagacacccgagatttgctatgaaaacaagattttctttagacttagcaatgcctaggctaccagtttctatgatcttgaaagtcttttatcattaagaatgaatttttaaaaactcatttgtcatcttcagatcattgatgtgtcacaatgacggaaaatctaaagtaatacacatgaggtaacaaatgtagtttccatacagaatccaaataacccacacagcaccacagactttttacttgcatgaggaatgtaacttagattcaaggaattctaagagtatgaacaagaaaataaattgggatgccatagccagtgcatcataaaaccttaagagggcttgctgagaaaggacataaaatatccccacattctttctctgtgagttgccagtttatgctctttcaggaatttgatatagtgatgatttccaggatatatttctttcaccattattaagcaacaaaaatgtaaatacattattttcttagccctttctaatgctatttgaattatttcctccaactaaagtgaatataaataaatatgtggaattttttttttaagcaaagcaaggactgtacatcataggtcatgaaatttactcttgacagttaaacttgggtccatttggtcataaaatttaactctgaatttcagtctatctttaaaaggagattcctttcctccgtttttgaatgttttgtgtttaaacaaaatttttgaatggatcaaaaaaatatcaaaggaaaggaactgtcccattgttgaatgcagagctttgacacaagtctcaccttctctggatgaggtaatcttctaggatgtcgaggcagcgcaccatctgggagaagatgagtactttgtggccacctgcaatcagcttagggagtagtttatcaatcaacacaagctttcctgctgcctgaatcatggcctgcagctgaaagtcaggggcatcagggctgtgggtttttcggaaatcttctagaattttctcctctgctcctgaaaaggaatggaacaaaactattcctcggacagaatataaggataaaggttgtactctgctttacagatcctgggaaaaatgaagtgaattcttaggtcctagaccagcagtccagtgaggagatgctgggtgcactctttggtctgtgccttcagcagagggctctgcagtggcagcaggagagaatgcgggtgctccactctcctgggaagtctcaccaagtagagagaggatctgagataccaagtcctaagctgactcacccaagtaaagaaaccttcccagacaagaaggactttcatacctcttgacatcacaaagactgtaagataatccaagccacattttgattttaaaatttctccaaaagtttcatagtaaaaaaaaatcctcccaacattttctctaactagtttggttaactgttaatttgtctacagagagttttaatctcattgcagcactttcactgattcaactaagtaacacatttccctgtccccaagtagaaagtgtgggccagactttgaacaaataaagggcagcaaactggtgagtgatatccatcttctgcccggcagagtacatgctgtgaggcagcttgttggcagaagttaagttcaaaccttggctcttggtccttagtagctataccacttaggcaaattcatcaagctctctgaatctcagttttatactctgtaaaaaggtgagaatgcgtacatcctagcatataatgaaaattcaatacatgagttatttgattatcattagcttctcgcagaggtcatggcagtcctgagttacttcctagtgcccctgactcaccattgatcaggtagggatggttacagcacttcctcagctccatcatggtgttgatgagattgggcatgttgtgctgatttgcccccttggtcaggaaggaaaagttcttctcgaggatggcacggtagtactttttctggatattggtcagttccacctcaatgatcgtctcttgtttgggagcaaggttcttttccacatcatctttcagccgccgaagcatcattggttttaggatagactgcagtttctttacctgtccagggaaatgagacctagttacctgcctcaatcccaagttaacgattactggggtattccaaccttcactctaatttcttgaacatttacccatagtactgtggtagtagactaaaagaaagattatgatcgacccctgaaaatggagagtttataatagtactgaaagggaataagggatatgattttaattcacaagcaattactgagaatctagtggcaatctcagaagataaaaagggagaaaggtataaaagagtacctattctctaggatggagaaaacatgtctctctgtcattctttctctaatacacacaccacatgcacagtaattacctgaagagtattttaaattatgttcggaggtatgagtgatatattacaaggaaacttagacgctgagagaatggagtaagaagtagagatgatctggaaaacaattcctcctataccttttaagtaacaatagcagcatacatgcttgggtgtagcagtatgtaaagaactaatgttataggtgacatctactctatcatggaatctgtcacatcaggggcactttaagtctgatggtgttctttgctacaatttgtctgttcttcccctaaaagcacaggcctggacagcagatctttatgcaactgactgcaccagcaaggtgacttgttccccctcccagtgagacaatgacagactgagggattcaaagtcaaagtacctgagttaacctggagctaaaacatgataccggtaagattaactctgatggtaaaacaaaataagggaagatgaaagtgcaaaagaaatcacgtttcaagtcagaaacggctgttcaaaaatttaaaaggggtagactctgcataaacaagttgtgtgctgcgagattgcttcctgaagaaatataaagtgatttacagagagtgatttagaagagttacttacaaaagcacattttagacaatgatgaacatgctttattttgcaaacagatgctttccagaacgtttatttactgtgttttaaaatacagacatctcatagagcagagattagagtagtggttaccagggactggggggtggggcggggtagggaggtattgttcaaaggatacaaaattttagttagacaagtggaataagttcaagagatctactgaacaacatggtgactacagttaataacaatgtacagtatttctgaagattgctgagagtggattttgaatgttctcacaaaaagcatgtgctaattagctctatttagccattccaccatgtatacatatttcaaaacatattgtacgtgataaatacatattttgtcgattaaaaaaataaagccaaaaaatttaaaattaaattgttatatataaatattaaaaagaagttttgatgtcatttttatggttttctcctacctaactccaatcttaatctttttatgagactttcatttttaccaaccaagggtacttagaaatcgaatcccccatatgggtaaggaattactatataagaacctaaagagaaaagacacagctagctgattgttaaagatagggacaaatgtcaatctgccacatgctgggttcagcttttgcccttctcttggttcataccttgaatcatttagagtttactatatgccagacattgtgctggtcaatacaacaaacacaacttgggagaagatgtgggccttgtcctcaaggagatcttttgtctaggaagaagaaaaaatgcataccacaaattaagtgcaatgggagaagaggatgcatttctaatggtccaaaaacggagagaaggttagagctggcttttgaaaatcaatagatagggcaaatgtaggaattaagtttgattattcactgctctgatgcaagcctgacttgcatcagaagtaggaagaaagagattggaaccccagggtgtacgcttgacatgtgggcaaaattcccaaaccttttcattcccctcattctttgccccaacccacttacacaccattgctggattaatttggcagagctaattatgtcattcctgtaataaggtcttgcatggcttctctgttacctactgaattcttcaaactacctttcaacatcttcccacaatataaccctaaacacttctgcttatattttccaattcatccactctgttttcagtttaatcagatgtttccccactagtgaataactaccatgactctgattatgctgggtttttttttttctatgcagagtggttaccacctcttctctccacacctgttaaaagctgcccatccctcaagatgcattttcaaattgtactctctccctagagtcttttctaattctcaaatagatgtaacctgtctctcctttgaaggaccacctctactatttgttcctcttatggcacgtacatttgtctgggttatttctataatccctagtggagattctataatccctagtagagtatttattactatcagttgttttttattagctttgagtccaacaaggtagacttggaactggaccttgaaaactgcagaaatgcagttgatctggacaaaagtggacttatcaactactccaggtatgtgactgccttcttttcctcactacctgtgtattgtgctgtatgcaagaagatgggcctgggaacaagttgcagattttgaagggaaaaggatgaaggatgagggaagcaaaagaaagcaccatgctcctgagaccagagctgtaagcaaaatcagcgaacgcacaatatgtgaaattagtgaagcaaggaggcccgatacaccaacataaaatattttgggcgcataagatattttgggtatggacccatctatcctctggggcaataagaactgctaataatcagcgtacccgccccaacatacacaaacacataaaataaaggaggtaacgctcattttaccaggaacgtgacaacttgctaaatcctggccccatagcatcctgctcttttcttgatgaagataacgatcacactgtctcctcaattctttgggtccctaattacctgctcctctgttttcagatctccaaattcctccaagaaagcggtctctgaaggaaactgtgatggctccagaaaatttaacaaactgaagagctcctccacagagttctgcaagggtgttccagtgagaagcactttatgttcctgcgcaaattaaacatacatgatggacagtgcttgagccatcaaaatagtgcattttcgtggggaaaattaagccagggcattgagtgctcaatttggggcaattctgatctgctttaatgaaaagataatatgccatcataggggtacagtcaataaacgaatcaaccttcctttcacatcactgattccagcagcacgttcatgttaattaaagcaactattcactcattcactaaatattattgagtgcctccccaccagatactgggcactgtgccaaggcagtaatgttaaaagggcatcatctttggtaccagttcatttaggggcctggaaaccagccaaaacaccttacatttccaagtcatatatttcatggtatttaagagtcctcctaagtctatggaaatcaatctgtggcaaaggtcaaattgttgacccagtttgtaaccaaaaaatcttaattcctatactattgcagttatagagaccaaaaaagaaaatctaatgtaaaacgactaggcagaaataagttacatgcagaatggctaaagagtgtttcctccaagctgaacaaaaggaacctgtgtttatgtaaagagatgctaactctcaccagggccataagctttagaccctccagaagtttgcagttcctattcttcagtctgtgggcttcatcaattatcacacagctccagtgaatcttcttcaactctgggcagtctgctaggatcatttcaaatgttgtgatgacgacgtggaacttgaagactcctgaaagggggtttccctgaggatgacacaaccaaagtcaaagctttacaccatggctatagaattctgctaatatctgctggactacaggaggcagcactacagatgctggggcctaggtgagaagacaagcactgcttttcctcatgtgagaaaagagaatataagaattaacgagctagttagccagaaggcctcacaccatcaatgaaacagaagcgagacaacatctgccctcacaaaggtgagaaggatgggcaatatggaaggcacagcaagggagcatttttatttattagctgtcatgataaggaaatcagataggtgttgttcacaagtccccagccaggagtccatctaaaccatgcatagtttgaatgcccaaaggaaactctctgctatttttcagacttaatttcaccttataatttgagttctagcacagattgaaggtaatgattctgatgcacctaagacaagcgctactaggcaggacacagctttgtttttcagactgtcttggtgttgccatcacatttcaagagcagagctgcatcatgttagagcacttcttaaatgtcttccaagtgtctctgctgtttttgaaacctctggagagaccactggctttcctctgattgaaatcgtttaatttttaccttaattataaaaaccaatgtgcaggacaaacacacaactatattcagctaagtgacagcacttaaaaacttaaagagaaaatgttgctgttgggtttctaatgatttgaaacctattttctctttatccttctctgtcaaatctgttaacctcctctccaaactccctggctgggaatccattctctgtatagtaattcttttgctcactttcttcactgaacacataacaattcagataaaatcttctgcatataaaagtaacttcataaaccaataagtaagtcaaactttcagtgtcctaaaaaaggtatatctcagagtttagacagcatgccctacaatcctgtgttgtatcataaattaaaacgagctaccagggagagcaggagtcagccttgacaaacatattacaaagtcattccacattaatacaagatgcagggcactggaacttctgaagataagtgacagaaaggctgttctgagcttaggcagtccctgggtctctgatctcacgtgaggctcacctgggcgtctctgtacaccatttcatactgctggatcatctgcctgctgatctggctgccgtggtacacaatggcattcatctctgtccatgtccggaactcccgctcccagttagtgatggtggagagaggggcgataatgagaaaagggccgtggattcctctcagaaatatttctgaaaggaatgtgatggactggatggttttccctaggcccatctcatcagccaaaatacagttttttctgcagagagtgagaaatataggtaattcattatcaatataggaaacttatagaggctggttataacttgaaaagatgcttcacatacctgtaagattatcattgaaggctttatcatcatttcacatattaaactgaggttagttattattattattcctactttgcctacttccaaaacagaaccatgctaatttgggagaaaatacagtcatgtgtcacttaaggatggggtcacactccgagaaacgcatcactgcgtgactgtttcattgtgggaacatcatagagtgtacctactaaacctagatggtatagcctactacatacctaggctatgtggtatatagcctatggcttctaggctataagcctatacagcatgtcattgcagtgaataccgtaggcaattgtaacaccatagtaagtatttgtgtatctaaacatgtctaaacacagaaaaggcaaagtaaaaatagagcaaaatatagattaaaagtggtatacctggccaggcgcggtggctcacacctgtaatcccaacattttgggaggccaacgcgggcagatcacctgaggtcaggagttcgagacgaacctggccaacatggtgaaaccccatctctattaaaaatacaaaaactagcagggcgaggtggcaagtgcctgtaatcccagctactagggaggcagaggcagaagaatcgtttgaacccaggaggcggaggttgcagagagctgagatcacaccattgcactccagcatgggtgacagagcgaggctctgtctcaacaaaaataaaaaataaaaaaataaaatggtatacctaggtgataggttgacaggtgcagcaaaccaccatggcacacatttacctatgtaacaaacctgcatatctggcacatgtaccctagaactaaaaaataaacattaaaaaacaaaaacaaaaaaggtatacctatacaggggacttaccatgaatggagcttataggactggaagttgctctgggtgagtgagtgagtgagtggtgggtgatgtgaaggccgaggacattaccgcacaccactgtagacattataaatactgtacactaaggctacactcaatttatttaaaaatattttttcttcaataataaattaaccctagcttactgtaacttttttactgatgaacttccaattttttaaaaaactttttgactcttaagtgttattacaaagagtcaagaagttttaaaatatttaaaagtttttgtatagctgtatattcccatatatatatatatatattcctataaatatatatatatattttttggttttgttttgttttgttttttgtttttttggttaaggatttagaaatagaaaacagctttaaaggatattctggattttgtttcatctagattgagcccacccttttggtgtggctggccaaaaaaaaaaggcacaaagtcagtgatgtctaaagatcattccttttggttggagaaacagctgacaaaaataaagtaagtcttggatgattaatgtgcaaagactaccaccctaaattgatggccatgctgctccctctcaccagtctgctactgcgactctaggtgttccaggctaaggcaataatatacctctgggtacaaacatctgggctggttttggttccttacctgttataccagttaaaaagaagccagttcatcccttccagctggtactcccggagctggttactgttcttatactcgcgagacttctcaagtttctgccaggagtctgaagcaggccgctcctagggaggaaagcaaacagcataatagatagagaatgatgttttaggagcataacatggatactaacgaggacagtggtaaatctcactgtcccaaggctggtttcaaactatagttattaccttctgagtaacgtataggttgggggaactaagtaggagtcaggctgagagaatggttaggaatcctgattgcttctagataataacttacaattagcttcagaatgaaactctccctgctttctatctggtccgtcactgcattacaccacacaccacaattagcctggtgctgtatttatttatccatgcacacacatgcttcttccattagactgtgagctcctgagggcagggcctgtaccttgtttcttaccatatctcacacaagaatcaacctacagcaaatgcttaatagatgactgacaagttgaattaaaagcagaaaacagtatttatgggagagggttgaaagaataataatcaaccatgcaaacaaaacactattaactatgtaagtttctaatcacagttctgcatctcgagacacctctatctacctttcatatgccaaagaaaacaaaaacaaaacactgctcttgaatggactcctacagggacctaagtttaatgttccgagtatcaaccttccagtgatgtaaaagcaagaaataatattaataaggaactggataacagtttttcatataaaaatggcaatgtttttttaaacagaaactgatcattccagcctatagccatattctttaacaactgattctcttttcaagttagttacaccttaataaagctctgggctgggtgtggtggctcacgccaaagtaatcccagcactttgggaggccaagacaggcggatcacctgaagtcaggagttcaagacgagcttaacatggtgaaacaccatctctgctaaaaacatacaaaaattagccaggcgtggtggcacacgcttgtattcctagctactcaggagtccaaggcaggagaattgcttgaactcgggagatggaggttgcagtgagctgagattgtgccactgcactccagcaacagaccaagactccatctcaaaataaaaaaataaataaaagctctgatcccaactcccctccttttaattgttggataatctatatacttctcaggcgccctgggagatcttggcagttgagtggtaataatccagaatcagaaaaacaaataaattcaataatgtttatcaaaaacctatgttctctctgtgggagtcacagggatctgcagataaaggacagttcttccacttaataatattccagttgagtgaagaagggaaaatcaaagaaaagaggtagctgatgaagagataagaaacaggaaagatactactgagcttctcttgcacaccagccattacttacaaattttattttactgactccatacaacagccgcacaccaagaaatctaagccaatatcaaagcttcttaaatgtcacatacatcaaaatagacctgagacctaaaggtgacaagggcgctgggaaagttcgatctggggtggaaaacactgaattgagggttcaatgagaagtaacaaaggtaaaataccacagaaaccacctaggaacaagccaggtggacttccatgattgcaaagttcataaaattacatgttccgagaagtgccagagagagacaaaactactttaccacatgcttaatttcagggagaacttgaagagattcaaattctttaacttttgcaggatctacatcttcctctagctcccacgtgctttcttcatatggtagtgagcaccacttcaccaggtaatgtgttacctcctggtgggaaaacaggaaagaaacttaatgttctattaggttaaaggagtcagtagtatctgccaacctctgaaaaaccaccctacgtgactagacaggaataccactaagacaagggtcacatgttaaaacaagtgaaatacgtggaaagaagggaagatgcttcaggagaggcaaatacccacctcccctgtttctgcatccttggtgtgggccacctccaagatgcgatcaacttctacatagtctggattgaacaagtcttcatcaggctaacacaaacagaggagaacagttaggaagtatgtccccttgcctcaaatccaacacctagggtgttatctctaagtgatccctactctaggccctatcaacaaacacaaaaagaaagggtttgcttaagaataaaagtcacggcatttattcactgtctccaaatcctgctctccatgactaaatttaaaggatctaaccatcttagtggctacaccctagccaggtaataattccctgttggtcattatagcaatgtacaaaaatcagcagaagggttcccttttccttactggtccttatttcaaacacagcccttggcaactaggaattacagtttctttttcttaataacaacaatagttaacactggcagggggcatgagggaagcttcctgggtgctgacaatgttctatttgctgatctaggtagtagttacacaaatgtgtttacattgtaaaaattcattgagatgtatacttttatctttatgcacactatgcttcaaaaaaagtttactacaaaacaacaagaagcaacatatagaaatacttaaggtatgtccagagtaatgctaagtactttcatttaagctccaaaactaccttacggagtaggtactataattaccttacagattaggaaactgactcagagatattaagtaatgtgaccaagttgacggagctatgttaactggaccgttcacccaggtctttcttacccagaagctgaagccctcctccaggagtgctgaagagctcttactgccacttaggctgcaaggcacttttggggctaatttcatcgtctaatcaatgcaggatactttttacaacatccctggcaagcctctcagattcaattattcccaactaagaaatttactacccttcaagacctgattcactgtcgaaacagctttatctctacctctttaggagtagcatcatgatctttatcattagtaaattataacttaacttccttccttataactgttgctcattggcatgaactgcttcctttacagcagcaataagaggattctttcctctctctttaggctcttcagcaatcccctccctatctgggttaaaaaaaaaaaacccagtttgttcaacagttcttcatataccgtttccatcttaatgatacgaaaagctaatacttatggagtagtgcctatgagctaaacactgctataaacattgtgtcctttattattcacaatagtcaagattacggaaacaagctaagtgtccatcaagggatgaatggataaagaaagtggggtgtatatacctagacaatagaatatcattcagctttaaaaaagaaagaaatcccatcatttgcaacaacatggatgaacctggaggatgttatacaaagtaaaataagcctgacacacaaagacaaatattgtatgatctcacttatatgtggaatataaaataatcaaactcatagaagcagagagtaaatggtggttgccagggatgaaggggaggggaaatggggaagacattggtcaaagggtataaaatttcagttacgcaggatgaataagttctggagacctaatgcatagcatggtgatgacagttaaactactgtattatatatttgaaatttgctaagaggataaatcttaagtgttctcacccttaggggggaaaaaagaaagaaaaaaaaccccctacttatgtgaggtgatggatatgctcactagcttgactatagtggttatttcacaatgtaaacatacgttaaaacatcaagttgtacaccttaaatataattttttgacaattatactccaataaagcttaaaacggcaagaaaactatcatctaatccttgcaggtattctgtgaggctgattctatcaggagtcctgctttttcctatgatactgagtttgaaagagcttatgccatggcctgaggccacccaggtgtgtgtgaggctgggctgggaggggcagtttgactgcagagcccaggctcttaccattgtgcagtccgctctccacctatgccccattcccaccatgacagtcctcttgcagctgccctcaggttttgcaaagtccctcactgaatcctggtacccaaatgaacatagcatttaggaatgaaaagggcatggtacagcaggactgttctattggtgcagtctaggattagtaggattcgtttactttttaaacagccatgtcctactcttgacacgcagtaaatgtgtagttaattgaactggcaatatgttttctccctagaactgctacccagtcattttcctcatttcagaaccagaaagattccaagaacaatgtaggatattacatttattcctacatttattcatcctaccctgtccaggcaaacccaggctgatcctgacatttattctctcagtattggatctggttagaacgtctcctgggtgttcaggagttaggatttcatcaggagtctatctctgcgcatgtgggaagttgcaggctcttggagcctgagtttcctccacgtgtgctttagctacctcataaagcagctggaaataatggatacaaagctctattcaaaactaagttactatttgtatcacaaaaatatttacccaagttactaacaaatatgttgaataggtcaagaccaaaggcagtgttgaactactcgtcagtattattcctccttaatttcatgtgttccaatcttctcaagagcctttccttcccacaagaatatgaactcttgttgcattatttctatatatcccagcacagtttcctctattctcggccaaggaaaaaccactactttgggaatagatcagaaaacagacacaaagggctgtgtaggctctattacagggtttagtctttattccaagaataacacattaaggttaaggtttgtggcattttctgatatatagcattatagatttgtttaatattaaaatccatcagtccttcctcttgctataggtacaatacttagaaattcccaagtttacataaataaaattatttatttgtttactttctctcacttttagatttgttttgttttttacattcaaactttaggaccttctgaaatgtcctttttgggttgcagtgggttgagggagcagggacaaaagaattgtgtgcgtattcctctcactctagctatttattagtattcagaccaagatgcacgccgttatgagttgtcagtttataaggtttgatccttaactttggtggatagttttctttgacttgaatctagactagttttgttgcaaatcagcacacatttatcaatttgacttgagcaacagatctgtataggaatttaacttggacttagaaacgtaaacacagtatttactgctgcaagaaaagcagcagtcaaatgagtcagtaaatattgcttcacctccgtaaaaatgtgcttcatctgggcttgtttattcctaaatcgcttgatcttctgtgcgatgcgaggatccttttcgagctcttccattgtggcccatttacaatgtaagtaggaactatccaaagacatacaaattgtcaggcaagcacataactagcaaatgatcgagctttaaggtgttcaataaacacggtgaccacctaacacagaaatagtaaaatggtttattgtgaaactgctggagattgggcttagaaagaccttccccttaagggcaacaacagaaaacaaaacaaaacggagtaattccaagcaactgatctctctgcagcttctagagaaactggctgagaacagaggcagggcagctgtgggcaggttatcattaacacacattagtgaaagtgggtctgtagcagaaaggaaaatatacaagaggggaaaagagcatatgctacaggagagtggttctctaccctggttgcatatgagaattgcccaaggagtttttaaaaacacaacaatccttgggccccactgagtctgagccaatggtcttgggtggagcaaaggctttagaggtttaaaaaagctctccaggtaattctgtgtgcagctataattgagcgttactgcctaaggtaaacttgagtcagccaagacctgtgggtcatgccttagaggcaagactctgaagatgtagaagataataaagtcacaagagaaaaaaagttttattcatataaaacccaaatacagagaatactttaaatagacgtacaaatttctatacttaacgtagaacagctccaagtcgaacggaggttctcctgggtgaacctgtaacaaacagcaagcagttatcagcccagatcccaggcagatcacccttactgagccaaaagaaaacaggtaatcaatatctctgcctgatttccataaagatttcttaaggcatattttcattttcccaggccttttcctgacacctattggtcaggttttccaaaggtggaatacacagctgcaaggtaaaaaactgatcttcctgatgtccttccaaggtctaggctgggacggcactcagctgataaacccaaactggcccaggacaatgagaaatgtcaggaccagagcctggtgtggaagtgactacattcatctctggcaccccactaacgcttcacttctgaaacaccaatggtagtcactctccaagtaaggaagtttactttcataaattcttgaagtaaagatgaagccgtgctctcaccagcaccaacatactctagcactccaagaatttcctataggagattcctacaatggccctgagatgtctgaagaaaaaaacccccacgtttccattaggactcatatgggtgtgtatgtgtgtatgtatgtatgtatgtatgtatgtatgtatgtgtgtgtgtgtgtgtgtgtgtgtgtgtgtgtgtgtattttaaatagagaaagggtctcactatattgcccaggttggtcttgaactactgggctcaagtgaacctccgatgttggcctctcaaagtgatgggattataggtatgagccaatgaacctggcctctattaggactttttgtccatctcttcttcttggccctctgctaaattgtggtgggctacagcaactaagggatatatggcttttgctaggatcacaatggaggaaatcatcagcttgagccattctagatattttaagagttttatgtcctaaaatgctctacaggggtaaaaataagtgttggctagccagacaatattcttgcctagctctcactccagccaataatggtcattctaggttctctagccaaaaatctcttcacagaagatgtaatctgtgctaatgatataaaagctagaaacatgagccaccaacctcctggacagtcttagatgccaggatcttctcaatgatgtttgcatcatcttctggaggctcctggggacaaagataaaaaaaaaagaaaattgctggaaccacagaatccaagaaaacaattctgtaagaaatactacaatgggtactacttcattcaaaagttcacctttgagtaccaaggcctcccatcaggccacagagtggtcaaaaggtcacaagcattttgcaaagctagaatttaaagtggtggcttctaagctctggacacaactctacaagagcagagaagtttttcagatgcaatttcagatctgcatttaacatacctaaaattggtcctcagatttaccttctttgcaaaactacctacatgttgctgcatacaattttcagaaagctctaagagtatggggtcttaaaattagttctaatatctaccagctattgactttaggcaagtcaattaatacctcctagtctccaaatatattaaaataggagttaaaaatacatatctcactgaattagtgggaagataaaatagtattactattggaaaaatgttttcacatactattcaaaatcaaggtataattattctctattaaattgtaccatctttcccctttgtagctggaaaaggctgtttcactgatcatcctttgaacgtaaatcccaactgaaaacctaaattcctttttaccctagataaccatcaacacttctatcctccaatctccatgaaatctctttctacagagtatttatagttaaaaacacaaaatgtttaacattctttctagaacctcaagcagcattatttctcagtggttcatatgcacaatgaccttttcagatctattacaatatgagacttaaaacaccatatgaaaagaacactcatcacaacaatgaaactgccaaattcggtattctgggttcctggctggaacgtcccagaaggatgatttgtatatcttcagtctacccattctagggtgtaaagccataaaattatagaaaatatctcttaagatcttaaatcaagcttttcccaggaaagtgatgatgggttaaaagaaatgaggaaggcatatggcagaaaagaattatggaaatcagcaagcaggcacaggcagatgttcccaaaggttacaaatatttactaagctctctcagacacatggcattgtgctagatgccatacagaagttaatccaaaaccacacacgtcccttctcaccactcaacaggaaggcaagtaaactataattaccatacaatagaagaaaggggtgtgaatacagactatgcttttgtttctctgtttaagtatttgctctgcttggttcctaaatatagataggtggcagggagaaggtggcagttcactgtttattgctgtcttctccctttactacataaaccttcagagggcagggatccttgttttatataccgacatagctagaccaggaaatgcataatcaataggtattttttgaatgctaaataacaagcaagaggaaaagaaagaaggaaatacagtgaggaaataaagggtcaaactctctgaggccacagagtagagacagctatttttcttgatttatgtcacttaatttaagaagtctcccccatctccatacactcagacttacatactgtcaggacggtaacagcaaagggccaaagctaggtgtgcattaatgagcagcaaggaccactaccactgatcttgcagccaactaactaaagtctgactatggcgagtgggcagtgaacaggtgctaggttaagagaaactagactaatgaaccagcttcctacctcatttccttcctaaatttttatcccacattatttatggagtgcttttagtttatgcactggccttacagaagtaaatgagatatgtctagtcttaatcatgaaggaactatcaggcatgctaacaaaatgcttagttactgaggtatggcatacttgtagtatgcagaaatctgaagtgtacatcttgacgaatttttacatacagaaatgcacctatataactaccactcaagatcaagtttatataatttttccaacactctgaaaaatcctgtgccctcactgtaagtaaccaatattcagacttctaccaccgtagactggttttgtgtattattaaacctcatgtaaatggaatcatacagtatgtagttcattcttttttaacactgtgaagtattttgtaatataaactatccactctactgttgaggaatatttggtttgcttccaatttttgtattacacaagaaatccatataaattatgtcttttggtggaaaaatatgctcatttatcttggatatataactaggagaagaaatactgggttatggggtaggtagatgtctaattttaataaatattgtcaataaataaataaataatattgtcaaaaattttctcagtgattgtaaaaattttgacacctaccagcaaggtatgggagttctgggtgacttgataatgtcagtctttagcatgttagccattctggtggatgtgtaatgttgtctctttaattcacattttcctgataacagaggatgctgtgccccttttcatatgcttactggacatttggatatcctcttttgtgaacctcctattcaagtcatttgcctattttataaattgttctttctaatttattttcaagaattattttaaataagagtcctctctcagatacacagattacaaacattttctaccagtctatggtttgccttttcaatcccttaatgtgtcttctgaacagaaattctatataatccattttatcaatcttttcttttatgaatagtatttttgtgtgctgtttaagaaatttgtattgccaccaacatcattaagctacatatgtaatttaaaattttctagtagccacattaaaaaagtaaaacaggtgcaagtaattttaatatatttcacttaaaccaatatatctaaattatcaatatgtaatcaattaaaaaattaaaaaatatgttaatagtcatttcataccaagtcttcaaaatatggtattttatatttatagcacatcttaattcaaactagctacatttcaagtgctcaataggcacatgtggctgatagggtccatactggacaaggtagttatattttgttcagctggtctatttgactatccttatggcaatactaccctgtcttcactcctacagcttgattacaaagtcttacagttaaatcttccaatttagttctttttcatgactgtctcaggttatgttagataggtctttagcattttcatatgaatttccaccaattaaaaaatgccctgcttagtttttgactgggtttgaattatagacatcttagcagtattaaataaccatatgtggctgggcacggtggctcatgcctattatcccagcactttgggaggtcgaggcaggtgggtcacttgaggtcaggaactcgggaccagcctggccaatacagcgaaaccctgtctctactaaaaatacaaaaattagcgtggcgtggtggtgcacgcctatagtcccagctatttgggaggctgagacaggagaatcacttgaacctgggaggtggaggttgcagtgagcgagaccatgccactgcactccagcctgggcgacagagtgagactccatctcaaaaacaaaacaaaacaaagcaaagcaaaacaaaacaaaacccatatgtgctacatctatttgtttaggtcttctttttcatagctatgtttttagcatagacggcttgtgtattttttgagttattccagggtatctgataggttgatgctattataaatgggatttaataattatcctttcctgatgttatgtcgctagtttatagaaataaaaaatacgtatttgcatattgtctttatgtatccatattgcatattatctttatatatccagcaacttaactaaacctacatttattatttctaatgatttgttagtacattctgttcaattttctacatatgcagtcacatcatctacaactaataaaaaagttttatactccctttctaatcttttaactttttatttattctttctctttattgtagtggccaggtcctacattgtatttctgagtacaaattatgacagtgaaatatttttcttactctcaaattcaggagaatgcattcaatattgtactacttaatacaatattatccaccagattttctcttgtggcttttaaatgttctctcagtctttgtttatatagtttaagatatgcctaggtatggttttcttttttgcatttttcctgctttagagttatctgattttgaatctactggttgatatcttccatcagtttaggaatttttggtcattagttatatcgtcaaatgctactctgctccaatctcctctatccctagcactccaatcagaaatactttgaactttcggctgggtgcagtggctcacgcctgtaatcccaacactttaggaggccgaagtgggtggatcaactgaggtcaggagtttgagaccagcctggccaacacggtgaagccccatctctactaaaaatacaaaaattagctgggcatagtggcgcacacctgtaatcacatctacttgggaggctgaggaaagagaattgcttgagcccaggaggcagaggttgcagtgagctgagattgcgccactgtactccagcttgggtgatagagtgagactctgtctcaaaaaaaaaaaaaaaaaaaaaaaaaaagaaatacattacaacttttaactgcatcgcacttgtctctctttcttatgcttttaccttttgctctgtttgattcattctttttcctctatgtgcttcagaaattttccattgatctgtcttcatagtcactcctcttctgctgcatctaatctacttataaacctatccacttggtcttgaattttataaactggatttttcattctacactgctatctgattttctttatagatgtaattctctgttggaagtcttcattttaaaattcatcttgtccatcttttcctctattttctttttttttttttttttttttttagacaggatctcactctgtcacccaggctggaaagtgcagtggaacgatctcacctcactaaaacctccacttcccaggctcaaatgattctccagcctcaggcttgcaagtagctgggactacaggcacaagccaccacacccagctaatttttgtattttttgtagagaaggggttttgccatgttgcccaggttggcctcgaaattctaagctcaaagcaatactccagccttggtctccaaaagtgctggcattataggcacgagccactgtgctggcgccctctattttctttaacattttaatcatagttattttaaagttctttcctcctgccaactctaatatctggatcacctagggtctgcttctattatatgattattctcttaatttttagccaccttttccagcctctttgaatgtctaattttttttattttatgttggacactgtggataaacaaattgtagcagctccaaacaatattttctactacaagtatttcccattttctcttagacaaccagggcgagggggtggtccctttgatccagtcagagactgagttgggtcaggactgagttactgttttaagattcaatccacctcttattttactgtttttggaacatgagtatccagggtcactgactgagagattggcaggtcttttttctcttgagccctgaaacatgctctatggaggttttgagcttagtattttagtcttctaccccatgcaggttaaaagtccgacaaatatcttaagcaagagtcagtattttgtggtaggtccattcctttagtgatttttttgtctcgtaagtaccacgcaactatgaaatttcaatctgccttctgtctgaactcctagcttcctgggataccccagaattcagcagaagtctcttgaggaaatccccttgctttggggatttctttagtttccaaacactccacgagccctgtatattcaatccccaccagggtcagatggtttctcttctatccagaacagtctcttttgtttgggccaaacctgatcctcggcccactcccagaactgagaaatgcctccagagaagaaaacagccagccatcgtcagcccacctccggatgactcttactgtctgatattttagttcatctaattcttgttgtttccatagctatttgatgcctttaaaaagagctttttgtaatttatatatatattttttccaatattaactcttattaccggagcagtctagggcctagtttttggatttcttctcttttctatctgtattcattctcttggtgatctcactcagtctcagggttttaaatacaggcatcatccagctcagaacctctcccctggcaatagcctcatatacataattcctatatgccatctccacttgagtatctcagaggtatttcgaatttaaaatatccactcactaaactcctatccaatccccctttcctacccctcctacctacagtcttctcccacctgagttagagtaaattatcctttcagatactcaaaccaaaaatcttggtgtaatcctaactcttctctttcctttccatacaccatatctgactggcctagaaatcttgttggctctatcttcaaagtatgtccaaaacccaatctatttctcaccatctccattgcttctaacctgatctgtaccaccttcatttctcacccagattattctcaagagtctcctaatttgtctccctgcttcagttcttgccccactagtctattcacaacctaacattcagaatgaccctttttattatgctccgcttacactgcttaaaacgcttctcttttaactcaaagtaaaactaaacatcttccaatgtctacaaatcctacagggttcctgcccaccctcccacctcatctgttatgtttcagttatccttgtccattcttcatgcataccaagcatgcctctacctcaggactttgtatagactattccctctgtctaagatgttcttctgccctgcacaactccctctctcctttacctccttcaattatttgctcaaatattatacttttagtgaaggcaactctgaccaccctatttaaaactgcaatcctcaccctgaattccatatcacccttattctaatatatttttagaatggcacttactgccattgatgtactaggtaattttcttatttaaggtttattaacagcctctctctatttacttctactctttagaagttttgaccttggtcctttgacctcccatgccgtgtaggttcaaaatctggcaaacactggagggagagaccagttgtgaatttgttgcaagctcttccacgagggcaggaatttctgtcccttttgttccttggtgttatttccagaaattagatagtccttggcatatagtaggtgctcaataaatacttctgaataaataatgttaggagattttgcaatagaatatgataatagaagtaaaaagcaagtactatgagaacacagaagccagagcacttgggtgaattagaagaggctctggaaatgatatgacgtatgagttacatctgtaggcaagcagtaaactttcatgactgctgactactttccccacctgctcctaagtctgtatatctcagactagcaagcaagcatccacacatgtacatacactcaaaggaacaaagttctcttctttactactagactgcttcaaatattttcttatttttacctaccatgaagaatagataaaaatggtttctgatgataggattttgattacaattcagaatatttaactaggaccaaatctaaagaaactttaatacatggatgaagaaagcacaggactttgaatactaaaagaagtcagggtttaaacactcttcatcataggaaattttcaagtgaaaattaaggagtttgaagtaaaatttcaattttttttttttttggcactgttaaaaaagagggtaagcactcatgttaaagaatcagtagtgatcatccaaatatggaaaacgggtttttattttatcctaatgaaacgaaaagggagcagcctttctgaaatacacatcgaagtaggaagggagctggaaaatcaggatcttttttttcctgaacagagattgtgcgtaagtacgatcatgtgtgtataaacactcagtgtatacagatacacacagatataaactaaatctgcttgccagacacacttccataacaaccatctgttctcaactgcttggaatttccttaaattatccttcaaagaagaccattttaattcatactctttttatgtcagagatttatataatcttaatattttatccttagggaaaaatttcaaaaacttttaaccctatttaccttcaacctcagccaactacctcttttacttctatttagcaaaccataaggagggagcctaacaagaaacaaatcatgtttcaaaccacagtatttaccaagtgccatggaatatacaaaaccagtatcaagcttgatgcccagtttcaaggggattacactcattcagggaagacaaaataaacatatctgtcttagaaatatcccaaggtaaatgctaattggttaaacagtaactacagtccaatgagaattcagaaagtgaaaacagcatggatttcacagcataggtgaggttttagttgggccctaaagaacagtggctcataaaagaggacagcaaagagaaaggtaagatgaaatgagagatgaaagaacaatcatataggatgtatgatgcatatttagaatgctaagtaacctgccttattagagagaaagcattacacaaaatgaggagtagtaatcagagtaaacaggtagtgtgtagccacatctttaaaaaaaaacacacaaaacacaggagttttgatctaacacgggagttaaaaagtaaccatcttggatttcgtgagcaggagactgagaaataccagcaattcccctggtattttgggaaagttatcctggtatccgactggggagagcagagacttgtggcagggaaactacagaagtgtgtgctgcagtaaactgtacactgggctcagcacagggggtggcagcagaaaccaagaggaaacaaatacaggaaacaacctaaagacagtgtgggaattggtggttgtacccagtgaagaaatgggaagactcaagaaattacccacccaggctgagctgacagaagccttatgatgaacggccccaacagacacttctgcaccgagtctcacatgctggcacgaagctacggcaatgtcaaatagcagcaaggagtctcagaaaggagccctttctgagggtttaagtgagacagagatgaataccagtgaggaaaaaatgccagtataaggaaatggaggaaacaaaagcctgggagaaaagaaaaatctctttcctttctaatacagaggcttaaacaaatcataccagtttatataatgagttttaaacatatttattcactcactgaataagttatttgataagttcaactaattaggtctttatactagctactaaccaacagaaacatacagttctacctatgctaagcaaaaattacaataaattaaaaagtgatgcctgtttttgcaaaactctgcaatctgattaggggaacaatcaggagtgatcatcaaaacagtatggcagaggcactgaaaatcaggaccatcacaggctatgaataagtggtgcaacgatcccagctcaatctagacttagggaataataattataatagtgaaaaacattatcaaacagaagatggaaagtgccacttcatctgaatagttcctgggagtaaatgtaaattttagtttattgaaactctcctacctgagaggcacataggacaaaaaaagatacaaatcctacactaacataactcatggtttagaagaaggaaacaaaaaacttggcaggtgttcgaaggacaatgacagttaaacatattagagtgccctaagagcaaaggggaggggcacttatccccagctcggaggagcaaggaactttcgggaggaggaaacaactgagctcagcctgccaggtatagaaaaaggcctatcaaagaagagtacactgtacgcagacacagagcacagcacaggagagcaccacgagccaaagccttattcaaattcaagtccttctgttccaaaaggcaaaatcacacaaaccacccaaactgcaggaggcaaaaactgagacaggcttgtcaacagtctttacattgtaaaggcactgcagaattctaaaagtttgtgttccagacaccaaaatcagtttgacaaagaataagaaaataaagagtcacatttaggatggaaacttacttcctgcccctgaatcccatgcttgggattgtggtatggagtgcaaagcagagctgtgataacatgccagtcctgagctaaagcgaatcctgtgtaaagatgttttcgcaactcaccacttggtaaccaatcctgaggttgtgatctggggctgggacaagggccagcagtcacagaattgcgttgagcacactgagaagatactgcacagatctgcagagatggcagtggggccattctggtgctgactccatccccttctctgccctgagctaaagctagcaggcaggcagacacccacccagagggccccgggagaaggatataggaaaaagccacctcttcttcaatgattttctgtgccactgcatgtgccttgagattgcctggaatcctagatgagattcaaggctttcaggcttttcgttagcgtgggaaatctttgctcaaacttcctcaggaagcccagtatgtaaaaacagttttaagtggagctgttttggttctgcagcaacgaggactctacagagcaccaattttgaaaatcactcggtaagccgatctctccagtcccctcactggttgtgtagcctgccctgcatgctaggccaggccttggctcggaggccagccccacatggtcgcttctctgaatgtcaaagccaaaaccatgaatcaggcctctctcttccttaaatttagtaaatttttttgagatataattcagattctaatttatgtttctccatatataaaccctctgtttgctacatccttagaagaaacaaaagagtcttaataagatacataacatttcctgaattatttctgttagttagatcagctactgatgcccttcaggtgccaggggagaagtcataacaacatctgaaatatgattaatggcttaggccaaatggctactaggagaaaataaaatcctgtatagtgttttaactaccaaaccaaccataacatccccaaggaatgaaaaccccattacaaagcaatacaattctatcacctcatggcagtcttgcaagtgctatttttaactattaatatttgcttgaaaagtattatagtgacaatatatcaaattattattcctactaagtgttatattcattagttgggtaatgaatataaccatgacatgaaatcaactgttatatgctagtcactgattaactgctgctatgtaactctgacctggatcgttctgggcttcagtttcttcattgttaaaatagggacaatagtccctgctccctgctactttccatgcaaacacagagtgaaagaataagcggaattatatgaaaatgctttaagttggaggcaaggtggtcgaggaagattaagtactatcagtttccataagacacactagcatccaggaggaacgacagatatttgtgctgctactgctccatacagtgtgaattctgccaagtcagcaacagtgactccataacaacagacagccgtgtcccagaatgtgctcttggcaataatgcccctcctacatgcacagcctgcttcttctcttgcttttcatttcttctctataagctccttggcacagacctctttttttcaacatttaacccttctctcctttctagtacctctgtattaagtgctaatactatcatcttcttccttgacactgctgtcaatggaaactgctaaaatgcaaatatagtggtcctactcctctgcctgaactcatcaatgcctcctatcccttgtccaatctgcaggataaaaactaaaaaccttaggtgatactcaaggcccttcatactgtgactgctcctatctctcagtcctcctctctcaccacccctcaaattataccccagcatccagccaagattatccatttgtcatatcacagcctgcggtgccattcagtttctggggttttataaagttcatgttggaaatgttcctcctaagttcttgtcttctatacatctgaccactcctttcctgtccactcctgcttctgttagcctctgtacccagcacattcttctagacttgcaatacatgcttgttgaattagagttccaacagtaattactagttcatttgatctcatccacttaacagcgatttattatacaaaagacttttacattttttttttctttgacacagtcttgctctgtcacccaggctggagtataatgacgcgatcttggctcactgcaacctctgcttcctgggttcaagtgattcttgtgcctcaatctcccaagtagctgggattacaggcctgcaccaccatgcccagctaatttttttttttgtagagatggggttttgccatgttgcccatgttgatctcgaactcctggcctcaagtgatctgcctgcctcggactcccaaaagtgctgggattacaggtgtgagccacaatgcccggccaagactttcacattttaatgagagacaagtaaaacaaaatcagagatcagacacattcaaatgcaatttgtgttgtggtaagtgctttaaggaagtacacaaggggctgaaacagaatatcattgggatgaggggcaggaatctactttagataaaagatcaggaagaacctctctaaggagataacattttaggcaaaactgataaaccagtcacgtaaagcatcccaagcagaaggaacaacagaggcaaaggtctatgggtagagaagaactgttagttcaaggcattaaaagacagccagtcttttggctggagagtaatgagacagggaaaaattgtttatctaaaaaaatgaagaatttggcaaaacaaggcgagagtgtgatcgtggagggtcctgctgagcacagtaaggagtctgaatgtcattcccaatgcaacaggaagtcaatcgaaggccacaagcagcagttaaaatgatctgacttatgctttagcaaaggccaagaaacacgtctgtcatctaggtcaaaatgactgtccagccaaggtcagtaacctcatgcaaaggccatacctccgcctgccaggccagtgtagaggctgagagtgcagatgttcgaccagctccaagaacagcaattgtttccccatcatcatccaccactttgaagtccaggtcctcattgtattttctgcgctttacttgccttcccgagcgtcgtttctgtagggcaaacacacccgtcagagaagctctctgagtgaaagacaacagcctacacaagaataccctcatctacatttactaacatgccaaggagtgctttcttgccttacaaaagaaatctttcttaaatacaactcttttaataaaaggactaaattcagtcaaaatgggatctagctgagtaggggacagaacaaaagctcaatctccaaattgccatgatccactaaaaagaaggggtagtgtctcatagtccagtaagatgtgttttgttcatcaacggtagtgactttccccctttcagaatccacttctcctccaataaaacaaggatgggagctgaactctaccatctttggggtcccttccagcacttggtggaagcacagattttatgacatgatgacagttttattgtttttgcttaaattcaccatccttaccacatacttctaaaaatgtagtttgaaaactaattagtatcaattttttggatttactttgagaatctcgtaacacttcttgaaatgcagggagacatcttaagtgtgacaaaacaaggtccctaagtcaccttgagtgtgatgatctaaggattcatctctaattaagaagctgtaccttttaataatcaacaacaaaacagcccagtggctttctacaaatagagcagcatacagtccatctctacatactaatcatatctcaacagtagaatcacttcagggaaccatttatcagccagctcactctcaaatatttaaatcttaaaaaacaaaagcaaaagcaaaatcccacctctcttttcttctaaaagatacctcctgagtgtctctcttctgttcctatcacttcttcactaagttacctctatgatgttttactttatatgagggattccacataaaaacctctccccaacaccacatacagatcaccattctacaaacacctaattccctgccaaatcccatcaactcaacgtgcttggctcctctgccaatctagacacttaacagccaccagccccagtttataggcagtgaggagtctgctctgacaccagacactgctgcttattaatactatgacattactagctgtcattttcctacagggaagagcagtgagaaacccatgaaggtccagatgatcctggaaggtatagtacgtcagtcttattctaaatgagccttgcagcagagtggctcagataaattgctaagaatatcagaggaaacaaagcactttcaaatattagacttcatgctcaagagaggttctcaactcagaaaatccctaacactgtcacgggcacattttggtatattttcaggaatctggtttagatgggcaactccttgtttccaagtttggccaaaccttccttacttgttggcataatggatacatttctgactttcccagcatctgggattatgaaaatatccctgtacgggctggcctggcactctgagcactaaatgcattacctgtatggcaaaagaggccttacctagcttggctcacaacttcattttccacatcaactccctctgcagcctaatatcctgctaccttccaggaatgaggcaaataccactaaaaaactgggatatcattagtatactgatcgggctagggcaaaagactacagtctacctgctcacccaccaaaacggtaaaagcccagcccagggctagggagtgtgctagagaaaggcatagaggagcaacacgatcagtgtcagccagatcccatccaggagccgtaatctccaccaggcctcccggtcacagctgtacctggctgtctgtagactcagtggactcctcaggactccgcagagatgggttcgtcaggccctgatccagctctaaactctccactgtagtttcacttttcctttttcctttcttctttttctccactggggttggtccttgctccttgctacaaggagaaattcagaattaaaactgttgggcagtttttaaaactaagatttctcatgtgatcaacgtcatgaaatcacatcctggaattctaggaccagggcaggctttaatggggaatctacaagagtttcttccaagaaataaacagaaacatggaaatatctacatggatcaatgcagaattcactttattacaccccatcatgactattatagctacaattaatatgtaagaaataatatgaacatctccaaaaacttcactttcagtttatacaaatgtcttctctaggaagttcaactgcttcacagatactaagaatcatcaaattacaatctccctttaagtttcttaggaagagacatctccctaatctgtcaccaacctctattgagtacacgctggacctggagtgaacactaggcactcaaaaatgaagagaacactgcctctgcccttgacaagcttacaattatgaaaatcctacagttcacctacaaccacagcccaaggcagtacatgaatgcttcctcagagaggtagagatgggccaagtccatccaccctgcaaggccctgctaagatggcaacattttctctaaaaggcctttcctggccttcctagctggtaaaatctctttcctacactcccaaagcacttccaactatactttgcttaaacgacctttcaccagaattagttgttaactacaatatgaggctcagaattcacataactaaatacagtgcctggatcctctacagttgctcaataaacatttgctatcctggataaatgagtattttatgcttctctgatctctcttatcagactcgaagttcctagagggcagtatgtgcttgactatgttttgtattcctcagagtgagtagtcttatgctttatgcatagtaagtattcaattaatatttaagcaagccttaaaactgctttttaagcaatggatagatggatgcattaatgaatggctatgattaactgtgaatggggagatttgagaacatgcatttgagcagagatacatatatgtgcacatataaaaacataattctgacagacagtagtaggaataacaataactaatgattgcagctaatactttatataataattactatatgcaggcacattcttttacatgaattattgcctttgctcttcacaacagccctgtaaagcagatggtaattttttttttttttagacggagtctcgcgctgttgcccaggatggggtgcagtggcgtgatcttggctcactgcaacctctacctcccacgtttaattctcctgcctcagtctcccctgtagctgggattacaggtgtccgtcaccacgcatggctaattgtttttgtttgttttcagtatttttagtagagatggggtttcatcatgttggccaggctggtctaaaactcctgacctcaaatgatctgcctgcctcagccttccagagtgctgagattacaggtgtgagccaccacacctggccagcagatggtattcttattctcattttatcttgaggaatctgaggcatggcgaggttaagttagatttccagggcaacagggttagtaaatggcagagacaagatgtgaacccgagtggagtctgtgctcttgatcatagcattcttggggaatagaacagtgttttggatacatttagtaaaagatagctggctctgtgtctggataacagggcaagtgaacagaagcactatgtgatggagctcaaaggaaaaatcaagggtgcaccaggccaggaagtttagacttcattctgcgtgaaaagggccatgaaagcaggtccaggaaagagggaatgaagcctttcaagggtggaaatgctttgaaaggcccagcaggagtagaaccaggaagtctcggcaagtgacagaaagtggggaacaagaagagccaacactggtacttcccatcaggagagttagtagaaagtttggggaagagaaggaaactggatgacctggctcagaggggtgatcaagcacacgaaccagccagtgctgatcgctcaatctgcctgcttccctcttgaacacccgtcacccttcatatgtccctaaccaggtcagcacaaactctgcccagcttctattccccaggctggagacgggcttgcctacctaccaggaaagttcatgatgaaagctatttgcaaactaacacaggaacagaaaaccaaatactgcatgttctcacttacaagtgggagctaaatgatgagaatatatggacacatagaggggaatgacacacactagggccttttggagggtggaggatgggagcaggtagaggatcaggaaaaataactaatggatactaggcttaatacctgggggatgaaataatctatacaaccaaccaccatgacataagtttacttatgtaacaaacctgcatttgtacctctgaacttaaaagttaaaaaaacaaaacaaaactattttgatccaacctaaagaactgaaactctaggggtcatgccatttttgaggattaccgatttttaacaagggacttgtacccttaagcaggggaaaaagcaaaagttcttccttttcttatcagttcagaagaggagactcaggtaaaacagttttaaaagatgctaaattttcacatgagtctttatctcatgttatgtggctcctcattaagaaaactgcatagcaaattacattctacaaagtacttatgaattccatgtctcatcccaatcccatgagggagccaggacaaataatccccatattccagatgaggaaaactgagatttaaaagcagcaaatgccccaaagtcagcagcagggcagaggcttacgctcaggtcagctgagtcacagggtattactttttcataccaagtcatgtattttgcctctttttttctaaaatcccagtctcccttttagtaaatgtaaaaacttcaaatatcctttaatgttatttgaatctcaaaataatggtttaaaaaatcagcaacattccaatgacccaaatatataaaattcacaaattcatagatgttgatagttttttatagctctcttagaaaaaggtttctttgacacaaatttaaagaaagcttacaatatcccaaaagtcaccctaataatcacatgctcagtggcctctgaatcttctgtacaatcttaaatctttctttccagcatttgaaatcaatttcatctacttactaaacgtaacttcattatattagaacactgtctgtatatgtttaaccttcattttaaatatttattgtgtgtatatgtgtgtgtgcgtgcgcgcgtgcccacatgctagaatcatgtgcttcactgtggaacatcatactcaaagctaaaccaagcccaaatcataactaaggaatagaacttcctcaaaatatgacacttcactaggagacttgtgtgcattttgagcaacatgttaaatgttgaaaggaggggggaatcatggtgaagcactttccaagtcaagcctgaggcgctactagattttcccagacagaagctgggggttaggtagcctggaaatactttctcaaatatttgtcagtaaaataggaaaataccggcagaaacgtgctcccttatttgcaggtaaagaagaagatactctacttgggaaatcttcaaagtgattttttggaggttacctttggcaagacaagccattttaagttccaaaaattctttctggagctcttctgataaagtcaagtttcaggaagaaaagattccctgaaagcttacaagtgggatcttcaaataggatattaagaaaataccatctgaattcatcctctaaaaagaccagataaggtatatatttctgctctttggaaaaagttttaaaaaccttatgcttgagagttttatcaactgaagacatttcaatctccaaactgctatacctatagatgatttggcccatgaatatttgtttgctccttgaagttccaggttcttcaaaaataatggataggccaggtgtggtggctcatgactgtaatcccagcactttgggaggcccaggcaggcagactgcttgagctcaggagttcaagaccagcctgggcaatatggcgaaaccccgtctctacaaaaaaatacaaaaattagccgggcatggtggcgcaggcctgtggtccccgctacttgggaggctgaggtgggagaattgtttgagcctggaaggcagaggttgcagtgagcacagatcatgccactgcactccaacctgactgtcagagtcagaccctgtctcaaaaacaaacaaacaaacaaacaaaaacaaagtggataaacaggatctaacaaaactacatatgcaaataatctttgactcagcaatctacttacaggaatgtaatctaaagatatatcacacgatataaaaacacatattcatgaggttatttattacaacattttttggtaattgtaaaataatgaaaactacctatctaaacataaatgactgaataaattaggatatatacaatgtaatactagacagctataaaaacaattaagaaagaattctacaaactgcaggaaacaattccctatttaataaatggtgctgggaaaactggctagccatatgtagaaagctgaaactggatcccttccttacaccttatacaaaattaatccaagatggattaaagacttaaatgttagacctaaaaccataaaaaccctagaagaaaatctaggcaataccattcaggacacaggcatgggcaaggacttcatgactaaaacaccaaaagcaatggcaacaaaagccaaaattgacaaatgggatctaattaaactaaagagcttctgcacagcaaaaaaactaccatcagagtgaacaggcaacctacagaatgggagaaaattcttgcaatctactcatctgacaaagggctaatatccagaatcagcaacgagctcaaaacaaatttgtaagaaaaaaacaaccccatcaaaaaatgggtgaaggatatgaacagacatttctcgaaagaagacatttatgccgccaaaagacacatgaaaaaatgctcatcatcactggccatgagagaaacgcaaatcaaaaccacaatgagatatcatctcacaccagttagaatggtgatcattaaaaagtcaggaaacaacaggtgctggagaggatgtggagaaataggaacacttttacactgttggtgggactgtaaactagttcaaccattgtggaagtcagtgtggtgattcctcagggatctagaagtagaaataccatttgacccagcaatcccattactgggtatatatccaaaggattataaatcatgctgctataaagacacatgcacacgtatgttactgcggcactattcacaatagcaaagacttggaaccaacccaaatgtccaacaatgatagactggattaagaaaatgtggcacatatacaccatggaatactatgcagccataaaaaatgatgagttcatgttctttgtagggacatggatgaagctggaaaccatcattctcagcaaactatcacaaggacaaaaaaccaaacaccgcatgttctcactcataggtgggaactgaacaatgagaacacatggacacaggaaggggaacatcacacaccggggcctgttgtggggtcgggggaggggggagggatagcattaggagatataactaatgttaaatgacaagttaatggatgcagcacaccaacatggcacatgtatacatatgtaactaacctgcatgttctgcacacgtaccctaaaacttaaagtataataataattaaaaaaaaattctacaaactgataggcaatgatttctaaagatatttaagtgaaaaaggcagtgttaaaagagtataatatgctaccttttgtgtaagaataaagggaaaataaaaaagcatgtacacatctattaatacaaaaagaaacagaggaagggtaaacaaaaaaccccacaatgtctatctacctgcaaggggtaggggagagaacagtagcagggatacaggagggagtgacacttctctgagtatacctctgtacacagatctgcctttaggaaatctgttaaagttctacatattaaaacataaaaaactaaagatgaaaacaagctgaaacaactgaatccatgtatgtttaaaacaagtagtataactacacctcacagagaataaaaccccttccattaattgattaacacagcatttgactacatattctccacttctgggggaaggggaaagtatagcaaaccaattctgaaattttttttcttggtagttaaatggtgaagtgactctgaaactatttcagatgtggcataggattaagcaaacgagtgaacgtattgatgttgggaactggcaaatatgaaatgctataaggcaagggagatactgtcagatgaatctcaactgcaggcatcatcagttgaactcatgacttctataacatgtatgaacacaagcatgtatatgtgcatgtgtatatatacacatataatatgtgtgtagatatatgtatatatgtgtgtacatatattcatatgtgcgcgtttgtatgtattttccccctagttttgacaacagaaagggcctaagagcaaagatgccctatcagcaatgagtacacctaacactcagatcttggtgtttaacactgaagctcctcacagaaatggctgattccaaagctaaagcagggaagacagacgatgagcccgaaacatcctgctatgtcagaaagtaagagggtgtttagaaaaataaacatggcatgtcaaaatgacaaataagttagcttgaagagctttcgttgcccaaaactgagaccatctgaacaccaaagtaattgaggacagtaaagaattataagtcactgaaaacaataggaatccataccaatgagacatacataaataatgaataagggataagggggagctcttgtttactacaaaatacaaatggtaactgtaaaggaagtggtagttagaaaataattttgaggctgggtgcagtggctcacgcctgtaatatcagcactttggtaggctggggcaggaggatggcttgaggtcagaagtttgagaccagactggcagcatagtgaaaccccatctctacaaaaaaatcgggaaaaaaaatcagccacacatgatggtgcatgcctgtagtcccaggtacttgggaggctgagatgggaggattgattgagcccagatggttgaggctgtagtcagtcatgattgtgccactgcacaccagcctgggtgacagagcaagaccctgtctcaaaaaaaacaaaataacaaaccaaaaaaacccattttgtaaccaacgtagaaaagatgcgcatggtgcagaatcatcaagggatgctaaatcttgggagaaagatgtgaagagaagcaggatatttgcatgatcttaaaatgtctccctgcagattacttattagttataagggaacgaaaagaataactagacaatggttacagaagaataagaacttaggaaagacacactgatgtatttagggacaaaaaggcctgacatacgtaacttgtttgcaactggttcaggaaacatgcgcgcacgcgtgcgcgcacacacacatacataaatagatatttattgaaataagtttataatataagtatatatacatatatacactttaaaaaataatttatcttgacatacgtctattccactgcagaagtggatactgtgtttggcatcttttcttctgacaaccaatactgattcctagactataaaagagctctggcagaaggtcagactgggctatcgtaccctattctttttaccatggtgattggtccaggatggacacatgacccagccagactaatctgggagtccttcctttaaaatatatatatatatgcaggagtgggtaggaaaatgaatctttcttcctaggtcatgaagttgttaagctgtaagcccacagctatgggcagccatgattccagccttgagaggaatgcatttgcaaagaatggagtggcacccagacaggcacagggggtcactgaagacaaactgccttggtctcaactaaacttcctggttctgattccttaagccagtgaacctcatcatcatttttttctaacttaagctaatttgattgggtttatgttacttgtaaccaagagagttctgaataatacaaaggcctaatactcccaccaattaatggcacaggagcttgaatcaaagcaatcttatttctataatcctcttttttattaatagctttcagagttagaacaaactaacttgcaaggaaaaaaaggaagaaataacatttttgagagtcaaagtaactattttttattaaaacttgattttacaatcaaacatatctccactttaaagaaagtacctactatgcatttatgacatgcaagaaactcccaatcagttatatcatacatgtaggacaactattagttataaccatcaaagcttttatcctgtcttccacatggcttcatcagccaagaagattttgtgcatctttactttctgtagtttgtcctagaaaaaacgtgttttttgttttttgtttttttttttgctttccaaataggaaatttcattatcatatgaaagcactaggatttctcaaactttctcttcaagcatatctccagtttctaacctccaggtttctttgctagaactgagagttaggaagtgagtgctgaatctgagtacgaggaaagatatgggtacatgtcacgacatcgtactactatgaatcttttatggctctgtccccgtggactccaggtattgaaagctcttatctactaagatgcattaattcaaaatgattcatcttctcattttaaaattaaaaccttataaaatatccatcagagccttacggaaagaatgcgttactactacagccaccgaaaatagctcatgatcccaatgactgcctccaaagacatgtagagtctcagaagtccagtccaggaaccactactccactccagcaacaatgcttcagagaagcttccagcactgaccttcctataggctttgatcttcttcccaggagtacaatactgaaaacatggatatcaccttgaaaaagctcatttgcacacttgattcagcttttccataataccggtattaactgagtctacatagaaaactgagttggtattgattttttaaagatactagttaaaagaaaaaatataaaaagaccctaattattttggtacagatataatctgctgtagataaactgtgaactaaatctgccctgtcagtccctttaaccgtatcatcaacaccttcaaaatggagattagagaggtttgtgatattgtcctagtaaaaaggaaacaaaaagattacttcctcttaagatgaaaaagcagagttttaccaagtagtcctatcaaaagtaataaaagtaactgaaaataaaaattcagaaagtatagaagagtttcaaataaaaagtataacccatcctcagtacaccaaatccccagagaggatcacttttgactgatgcctctctaaccccaaatacgctcatgcttctagttcattatttatcaacattaagcaatggctactgacatcctgataggaaagttgatgaattcagatctcatatacctcccctgttgctgtccctactcagtattttcgttgaactctcttagtggaggcaaccacactttaaattttcattaattctttgcttttctgattgctcctctgtcatgacccattcttgtgttgcagacaaaataacctcaatctgaggatgctaatttaaaatgtgttcattcttttccttgaattatttcttctgatgacagttgttcttttctttcttccttttcctgctttatgctgctcgttttcctctacggtcttggggtcttcagtagactgatttcctattgaaaatcaactaggctggtaatacaggtgcctggtgaggctctcctctgctgccgagtaaactgctttctctacaagcctcgcccctgaataggaagcctggcctaggacaccgtacacatggcaagacttgtcaagtggctgtccctccctccactttttagggtatgggcagggaagggcagagaagttagtgccctgtgcccccttcctgtgggtgtcattccttatatggagccctagccccttccccagggcaaactgcccaatatccttagagtaattgcctgagttcatcctggagctgacaaaccacacagccattctgcagacagtcccttaatcagccacctccgcttctggcctgcctccaatccctcctccagagctgcctgctccattgcaaggaggaaacacctctatgtttgctgcaaacacagcgcctgcctgagctctgagctaggactccctccacaccatttatccaccagtatgatcccactggacttctttgtccagaaattcagtaatagctctcatctgtgaaatatttcttcccctctgttcttcctatcatttcagtaagatttggataagaagtgaaaatgaaagcaggctgcgtgtaccatcttaaaatctggaagcccctaaaaagaacatttgtttaaatgtcttttggtctttttgctttaagccttttctcatctattaatttctttaataactggatcaatactcatctcttccaagggactccccagaccagaaatgacatactctttaccttctaaatcctttcagctactctgtatgcagttatatcaggtttttcatttgtttatatttttgcctgtgtcttgaacacttgtcaaggttgcttcttgtgaaaagcacctcaaattcataaaagtacctcaatgactagtctcatagatacttctgtgacactttgcttcctttccctataaaaaaactcataaagcaagacacagaagaggcaataaaaatatactggataaatgagtaggcatttatcaagcattattatttagtaactctttccttacagatttggtaaaggtctactatgcaccaggccacagagtaagcacttctgatgctcttaaaaaaaaaaacaaaaaccccagaaataaagacttagtgcaaagcttccaaggtgggtctctgacattaccatttagatttcttccctggttaacatgaagtccaatgggttccaagctcagggtctctactgaggactcatacacaccgttatgtcttctttattctaataaatggtcacaatgtaaaaacaagtctcccaacagaaagaaccccactaatgtaatctcttgaacctgaaattagcctcaataaagatctctctaaacagatagctgattgaccttcaaataaatgagaaagagccaccagctcttgtgaggaggaaaggtagttgagttctactactcttcctgcaccacacagttatcagctgactcagcggcaatcaggcagctcaaatggttatataatcagaaggcctggggtttaacacttcgcagaagcaatcatcacagatgaaagcgaaaaaaggtaaaatgctggatttgggagaaaaatctgctctgggctgacaaaccaaacaaatggggatgaaaaactgaaactggggctgatcacaccaaccacttcttttcctctttttgctttttcattcctagcagacgttacatataaaaacttacacaggctccacttttcctgtgatctttcacctgggaaacatgtttctcaaaggataatctaagaatcagccacactctaattacctgggagaattttgaactgcaaattcctgggttccaccccagacctaatcattctctctggggaatccacttttctaacaagctgtccaggtagttccctaggcacagcaaagtctgaggaccagagatccaggtagatagacctccacttgggccagcacattgactaatttcttgacttgcaagaaagaatatgaaccattctcatatgtgtggaaattccaaagctcatcctctgccctcaccaacaacatgaacaccaaaactcaagaccctagcttttaaaagcaacattcaggctgggcaccatggctcatgcctgtaatcccagcactttaagaggccaggcaagcaaatcacttgaggacaggagttcaagaccagcccggccaacatagcaaaaccccgtctctactaaaaatacaaaaaataaactgggtgtggtgtcccagctactcgggaggctgaagcagaactgcttgaacccgggaggtggagattgcagtgagccgagatcacaccactgcactccagcctgggcgacagagcgagaccctgtctcaaaaaaaaaaagaagcaaccttcagctcagtcaaaatgcttggctccctatgtgagaaagggcaacctaaagagctggctacagacctactcctcagatactcactccctggatatagagtaaaagaatcagaaggcttcatacacaactgaaatggatcatctttcctgctcactcggctgtgccttaatgccacgaagctgactttttactaaaggctatttcaggaagaaaaaaatgaaattcacaggcatttagaagcattagatgcaaaaactgttgttgagcacagatctactgcataacagttcttgctataatctgaatttgtcccccaaaattcctgtgttggaaacctcatgtccaatgcagcagtgtcgggggttggggtctaataagaggagatcaggtcaggtggctctggactcatgaatggatgaatattgttatcacaggagtggattctcttgagagtagccctctctcgttaacatttcatcctctcttgctcctctctctgcctttggccacaggatgaggagctgcacacaggtcctccccagattccagtgccatactgttggacttcccagtctccagaatggtaagccaaagaaatttctgttcattatacattatccagtctgtgtattctgttatagcaacataaaatgaactataacagttccctaataagaaatttctttctcaaatggtaaaaacttagcttctctgagaaactggcatgttgcttttctaaggccaaaacattatattcaatataatgaacaattttgggaacaatatattcccaaagcccttattaacatttcatgaccctacatgacctgacccctgcctttctgatcccctcctccagctataccagccatgtacagctatgtatgcataggtatgtgtatatgtttgtatgtatacacataaacgtacatctgtgtatgtcttcttaggcaagtggctccaatcctctctggaataaggcactataattttaaaaatagtataaacatatgagttataccaaatgaaattttaatttcagagtcaggaaaatgacagagcctaacttggcttcctgaaggagctttctttcttgcttaagttttacacaataaaggaatgaactaaactcatactcaaaaataatttagagaattaagccaggtttggtgatatatatctgtaatcccagctattggggagaccccatctctaaaaaaaataataataataatttggagggaaaagaataaatactagtttcaattgaaacttctcctatttaagaattttaggcttttatctcttaagcaataaatgaatactgatcactattaatatcatccttgaaaaggaaaatttgctagactctacctatcacctgtttagaacagacatgttcaataatctgcttgttgcctctcaaatgcaaacacaaacaaaggaaaaagttgaagacattttagtccttgaaaggataccatggagtatgcaaactgaaattctatagaagagggaccatttcctacaaataaaaaccaacttctctgacactgaaatctccccacgtccatttctgatcttccttagcaaaacataaaagacacacggctatggagagaaaagtcggttttacagtcaggtgaacctggagtcaaatcccaacaatggtgctcactagttttgtgccttggacaagttacttaactttttgaactttcattcaattataaaatggatatattacctactgttatataacaataggagttataagataccttatacaggtcttattttcaaggagaagagctctatccatttattcttggtatatatacatatacatatcttaacttttgttgaggaaaacaagtcacacatacctgaaaaccacaattaatgacgggaaaagtagcctgttttagaggcaaacatacaagactgggaatcaggcctgagattataacacacatctgtgaatgaccttagacaagtcacttctctgtgggtctccgtttccctggctgcaatacaacagggctatggaagttcagaggggacacacaggtacactggtttggggaaactctgatatatatctgaactctgatatatatctgaactgagacttgcactcagacctgaagaatggaaaggacttgggatactgagagaagggtaagagctggggaaataccaagagcaatccaaaggagaagtgggtcaaggacctttaagaactaatgagattaatcgagttggccaggtatagcgccagagatggaaagagagggagatgtcagaccccagagggtctgaataacagaggaaggagtctggattttgtcctggaggcaacaggagcaatcaggggacaacaggagcaatcagggggcaacaggaacaatcagaagattctaagcggttataaattgttgagggaatcctatttccctgcctccatgttttcatgaggaaaagcatattttattcccaaggactgaaaaatactggaaatatattttccacccttcttcaaacttatctcacttccccgactggggaaatacccaaatagcaagactggaagaaggaatggagcacacatggcccagcaccaccacctctgcttccgagtgcctgcagtgctggcagataaactcaagtgagagagtaacagcaagtctgatggtggccacaagctaacaaatgtttttcaatccagtttaccaataaccgagctgataaacgaatgcccatttctattgactatttctcaactgatttagaattgaaaagggagaaaaggcgatctgatttaccaccaccaccaccactgttgccaacataaataaaggggccaacagcagggcttcagaaagactagccaggtggcagctggcaagatggactgagggaggaaaaggccagaagcccgtaaatcagttgcggagctaatccaagcattaagtgagtcatttataaccatcaagtattaccagggtctaatcgatacctgctcaaatcaaaacacgtacttgagccaatctgcaagagtaaatcaacgagaacaaaaaactaaggcttaattactaacatatgcatatatacatatgtgtgtgtatatatatacatgtatttttaaatcaattaacatgcttcatatgtaaaattgcttctgcctaccagtaggatcactaattaaaggaaccaaaacaattttacaaagatataaaagagaagcaatcaaaggctaaccagtccagaaccctggagtacatagaagaattctattatgttacagatcaatgtaatataactctaaaataaagagaaagctcatgtaacttgtccacatttttaaagagatgatcacttctgtcagcctcctctaatagggtgtctcttggacttctaaacctcaaaaggttctgctgtcttctaagttagcagcctttgaaaacactgccaagcacttctccaactcacttatatttcatacagcctaattagatcaaatcaagttgcgttaatattgctacatttatataacaaagactgtacattttcactagacagaatcctgattttgcctatacatttggcatccaacactttgttaaatgcctccttattcccccaaaatggaatttatgacaatgtttgcatactcatcactttgtttcagacctcatacaatgtaaacatgaattccttaaaaaaggaggagttgataaaattgtaaacatcagaaaccagtggctaagtgggctcagacacctatggctttctaatgtcttctagatacaaaccaagacttcttattagggctataaaactctcctctaatcaccctaaattctcaaacacaatctttatgccttattattctctgtaataataataaaaaaaagttgccacactagctcatgtctgatcctccttctttatatatgctattatcccaaagtaccacttcagttcctccaaagtaatctggaaatgaaaattatttgcagaggctgaacagtcactctgctactccatccacacactggagactagagtatgctcactaggttcactaagaaacaaatcctgttaaggttttagttaggcagaatcctgagttttgtctacctctctcttggccgtctgtaaggtattttatgggcattttctgtaacctacattcctgagatcccacccaagtttctgtggtagatgaaagatgaaattccctgccagacagaagggagtgaacattatgaggcaaaattttaatttggattaagaaactatccatctggtcccaacaagctgtccttctgaaaaagaactgaaccatatagtaaactccacgttgcaacacacaccacttaaaatgcattcttaaaattacctccttcatgcctgaccaacacaggtgtgatggcctcattactttatgttttgttagtatccacatcagtctgtgtttttttatgagtgctcttggtctaaaataatagatacatagataaatataattaaccttcccttgcacttagattttagacatgtaaattccttaagataggagtcatgtatttggtgtttcctcaaaattctaaatataaagttctccacaaggaatttagaaacaaaatgagaaatataatatttgcatatgatgacagatacggaattccctgcacaaggaatgcatttgctgtcttgatagggtctatacagtgaatctgtacctatgcactctggtctctctgtaagtcattatggtctcctctggtctcatttactcagcatttcctaagcacttgtcaatgtgtcaagcactgtgctagacaatgaactagataaacagatcaggaatggtcctgcactcagagcttggaacctaggggaacctagtcagtcctcatctatctggaaatctgtgcatactgacggctctctcaggcttcctgcaccactgattcccgtgactgtgcatcctcctcatagcagctcctctgccactctacacgactgctgttccaaaaatcactgccccctgtatcacacctgggatgtcacttcccttacaccctgtgcatgttaacattttaattctttttagtccaaaaggaatggcaagaaactgcatggtcagtattaattaaggttatctttctctcattaggaggtaagaaaagtggttcatttttggctgaaagctaatatagacacaaagaacatataaacatgggatatagggggtacatctacacagctagcaactaaataatgctaagtactaagaccaaaaagaatggttggggtctgaagggggtggggaattcttgggagtatcctaaaaacacaaatgtcgtttttgaaataccacgactttagaaatgcaatgagaaaacagcaacctccaaggacagccccttgcattagcaccaaggggttacccctgctccccatcctatacaggtgagatgtgaagcttaggcccacaggagtgcagcagggttatgcctaggggcttgggctaatgccaaaggcaaatcgttctgcactggcataggcaagtgctcagagaagggagaaaggaacgtacctggccttcctggacttcgtcctggctgcagagtcagtgcagctcctcttctctttggcctccttggtgcccgaggcctcccggggcttccgtgccttctttgccccatctttttgcttcggctccttgtgctccttggccttcttcggctccttggcctttctgggttcctttggctctttcggttctcgtttcctctttggcttgggctctctgtccttgcttccctttgctgcaccctcttggtctcctggctcctttttcttccgtttcttcttcactccagtacctcctcctccactgtcctccatcccattatgggatgtcattttcctaggaaaaagggtagcagcttcctcttcagcagtatacaggtccttctgaggcagacagtgactagcaacatcttcaattttctcttcttgatcagtgctgcagtcaaatggggatggagatttgtagtcaaaattgacagaggcatcagacattggggagtgattcaaaacttttaaatttgacaactgtaaaagaaagagaaacaagcatattacccttccaattcatgcttcagacaaagagagttacccagtttgaatacatggatttgctcaacaaatatttactgagttcccactctctgttagttcctattgtgctaggccttggagacagagtggcaaacaggacatacacggcctttacacttgtggagctgtgccaacgtgttgttagcatactaaatcaggatcattcaaaggtaggcctttgattttaactaaaaattgtgctgttctgtatgatcatctaatctagccaccagactgagcaccaaataacctttagccacttgcaaaaaccaaactacctgtataggaggaagttttatggtgatagatgccattagaaaggatgtgtcacaggtgctcaaggcatccctaaaatggaagttgcaaagctgtttttgagcaccaacaaataaaagtacagccccccaaagtgaccactttttaagaaaacatccctttgggtttagaagttatatctcattctttcaggtctggtgttgcaaaaaatatttacaacttcacaacacagctaaggttggtgatagtcggtaacaatgtgggtgttagtttcaaggaacagcaccttctccttggtctggaacaaagaaataacttaagaagagcctgggagggacaagcaggctttctaagaagacagttacaatcatctttgcatgatggcttagaaacagcaccatttgtgaggaacctgctctcttaacaagaggcctggcatgtgctaaagggcacagacagttgcccaggtggcatggtttcccttcagtatgctggttacccaatctgtgctcagacttcctggcccaccctggtagttacagagactgtaacattcagctgcatattcccccttctgtttttccagtttctttccctagtccaatgctcccaaacataacactgagaatcccaggagaaaaagatgaaagaaaggaaagatttttgggggggcggggggcagatctttatcatatcaatacagtccagcctcataagcctaaatacaaagggaattggtcattctgacaggactcactactttcaaaaataaataaataaataaataaaaggaaaacaattcagtttgatgatctcattgctgattgagcacttgagatggctttggaaaaggaggagataagtggacataaaaggaatttaaaatcaaatacaaaaaaaatggttaaggtggtaaattttctatcatatgcttttaccacaattttaaaaactgttttaatgggatacaaggcaagaagaaatccagcagtgaggtgacaggtatccaggtaaagcttggctcctgtgaagtgcagagctgtcctcggaagattcttgaattctgtgccaaggatgcctggccctcaaggaacaagtttttgcttagcatgcaagggtgtacagactgaaaaaggatgagtcacaggtttcttaggctttcaaagataacataaaagatctactcccaccgaggcagctctctgaaggtcagagtgagaccctgtcttttcagctcatatctcatgtccaggacccttttctgaaggacaggggtccccaaagaagctagaagcaggtggcagtaagggagcattcaatccttaggcaatagcaagagctgcagctaacatttattgaaaacatgccatatgggtacactagggcttctgcaaggcatgtttcatgacctgtaatctttataacaatcccacagggtcaatatgaagatgccaattttgtatacagagaaatggaagattagtgatgttaattgatatgcccaaggctatatggctactgagtgcaggagcctggatttgaactttccatctggccaaagctcacacccaattcattgagcattgtatgacctcctggggaactacaatgattgctaggccatgagaccagcatgatggaacttggttagaaatgttaaatgcagccaggcatggtggttcacacctgtaataccagcactttgggaggctgaggtgggagaaccacttgaggtcaggagttagagaccagcctgggcaatagagcaagaccctgtctctaccaaaaaaaaaaatttaaaacatttgccagcagtggtggtgcacacctgtagtcctagctacttaggaggctgaggcaggaggatcacttgagcccagtagtttgaagttacaacgggctatgattgtgccactgcactccagcctgggcaacacagcaagactcaatctcttaaaaataaaaataaaagttaaatgtgatggcatatgcaatcactttgggaaaggtcatgcagttcttgatgaaaaagcagatattagtaataaaatatataaaattataattgaaaagtctaccagaaatgtttgtatttttaaggcaccttgttgggagctttgaaaacatatttgctgaagattaaaaaatataagacaaaaaaatttctttcatgtgtctcaaggtcagcaagggaaaggcaaagagctgaaataaaagctttgtttcagcttctaccaaggacattaaattaccactttgaaactggccctaaaaggaacaggttgaagatgatgggccacaaggtgccaaaaatattttacaaattataacaacagtttaaatagagacaagaatctaggaaaacaggaatgaaatggacaggttccactggtaacacatgcaacaatgctagctcataaactgcactgttagtaaaaaactcgtttctgtgattcaaaattatcaatccacaatattcctggaaaagacacttaaagacttgaatctagataaactggatcaggtcagttgaaaaggagctaagaactaatgaaaaaattatggccctgggcagtggttccaaacagaggtccatggacaaacctttaacaattattcaagaacttgaaagtcaaaatagattctaattaagaaaatcatccagaataatgagcgtatctgctacagaatcttcttcatcagttataaccatttctataccttttcaacagaaagccttgaaataatatgctaaaactcaggcaacaaaaaccattaaatttcagtacatcaggttaaaaaaaattaagcatatttcactgtatttttttgttttgggtcaggaaacatatatttctatctgtaaggaatccatacatggatacctgacaatcattgcctataagctgcttccaagctagtactgttctctatccaagctcctgaggaatagagagagagcctttcactcttattcatataaacagtatttactggccatttacaagtttctttaaatattggcatggcaaacaggcatatatagagatgtgaaggttgaaagggaagatactctccaagttgtgatgacatttccctctcccaaatttaggatgattctttctttgaaagaaaaattaaataaagtgataatataatactattagacttcccccaacttttcctaaaagttgcatattttatgtgaaatatagtaattaaggaatttaaatatttttcatttaaaactttaatacacttatcaaaattaataacttttgcactttaaagaatattatcaagaaagtacagttggccctctaaatccatgggttctgcatctatggagtcaaccgaggattgaaaatatttgaaaacaaacaaacaattaaaaatgacaatacaacaataaaaatacatatttaaaaacaatatactacaacaactatttatgtagcatttgtgttgtgttaggtcttgtaagtaacctagagatgatttaaagtgtatgagaagatgtgtatgggttatatacaaatactacaccattttaaataagggacttgagcatcctcagattttggtattcatgtaaggcgttagaacaatcccccatggacgctgaggaagaagtgcataaagaaaatccccagaataggagaaaatatttgcaaatcatttatcagataagggtctagtgtctagaatatataaagaattcttacaagtcaataataaaaaagaaccaaattcaaggccacaacgagatactattttatacccacctaagatggctataataaaaaagacaagacaacaataattttggcaaggatacagaggaattgaaactttcatacattgttggtgggaatataaaatggtgaagccacttaacagtgtgacagtccttcaagaagttaaacacagttagcaaatgatccagcaattccatcatagatacacacacacacacatatacacagaattgaaaacaggtgtttaaacaaaaacttacacacaaatgttcacagcagcactattcacaatagccaaaaggtggaagcaactccatccatcgacagacgaacaggcaaacaaaatgtggtatgtccatacaatggcatattattcagccataaaaaggagtgaagtggggctgggtgcagtggctcacacctataatcccagcaaaggggaggccaaggtgggcggatcacatgaggtcaggagttcaagaccagccaggccaacatggtgaaactccctatctactaagaacacaaaaattagccaggtggggtggcatgcgcctgtaatcccagctacttgggaggctaaggcaggagaattgcttgaacttgggaggcggaggttgcagtgagctgagatcgcgccactgtactccagcctaggtgacaaagtgagactctgtctcaaaaaaataaaaaataaaaaaataaaaaaggagtgaagtactgaaacatgctacaccatggatagaccttgaaaacaggctaaatgaaatcagccagacacaaaaggccacatattgtataattccatttatatgaaatgctcagcaaaaaacgaactcaaagagacaaattgggggttacgaaaatgttctgaaattaaatagtggcgatgtttacacaatcttgtgaatattctaaaaaccacaaaattgcacatttttaaagggtggattttatagtatgtaaattacattttcattttgaaaaatccagtactaggacataccaaaattggtgctctcaaatattgctggcaagagtatcaactattaaaagcctttttttgcaggacagagtagcaacatgtagtgaattcttataattttatgttgcctcaacatccattttggatgtacactggactttctcataccagaagtggagcttgttcaagcttgatacagtttctacccttgaccctgcctcctcccagttcctcaaggtggtcaatccagatatctgccttttacaactgcctcctggtgaccacccacctatgggacagccacagagcctacctacgtgtcttgctccactgaccccataccctgcatggactgcccagatacgccgcagtgactccactgaactctaactgcttgctctaaacccagcaattagaactccctgcaggaaacctgcttgggtaatggttaaccgcctggaccctaatgaaggctttgatccatgggttggttcatctttctttcttgctccccacacactgactgaacatgcgtgccctggatagctcttcgcttctcactggctctgtgaggtgtgctgctctcttctctctaggatctgcaagtaataaaactgcttctgttatttcatgttttgttatgctgtcttctctgtatctcacctgactgacacacattaacctaactctcctcctgatcaaggctctcctcgagagtggttatcttggtaggaataaaatggacccaggacacaggttagacaagagccacaaggtgtctgccagtataagtaagtcttctgtgagagggacacctggtcactggtcacttgcattaggctgcccttcaggatagagaagtatccagtgaaaggcacactgtaaacacacacgaccaccccactggggccccatgagggcagtgctagaaattacagccactgcccagggagtgaccttaagaccaaattagataaaaatacaacaaaacaatactaaaattttaattgtggatatccttttaaacagggcaacttctcttctagggcataaataaaggaaacacataataactccaaaggattatatataagaatatctgatacacaattgtgtttaatagagaaaaaagctataataacctgtttgccaatctttaggaaaatatttaaattaatagtacacccatcatctggaataatactacgcaaccattattatacggaggtttaaaagacatgaaacatgtctacatttgggaagcaaaaaaagaaaacctatggtctaatcacatttttgtttttaaaaaatactatacgaatgctagctttttaaaacaattttttaaagtctgcaagggcacagaccaaatgttaaccatcatcatgtctgggtgatacgactgtgggcagctttcacttcttttttgttctttgtttttacctgtctcccatgagtagaatgtaagcttccagaggcagtgattctgtggtagtatctagaaaagtacctggcttatggtataattcaatcctgtggttactgaatgaaagaaacagttatctacaatttggaaaagagaaaaagggagtctatagaattgtacatgtaaacagaaatggcaataaatatctgtgcatagaacaactaatggaaggaaaacaaaatgttaatagtaatcatctgaggctatgcaaatttggctgtttatttctaatagacatctacgatttcaataatgagaatgtattactttcatggtatttttaacagaaaaactttcatatacatgtaatagaaaaattttacagacttctataataagcgggaaaaactgttttaccagacaatccatgtttctcccaatcataaggattcaagaatcaaaggcagaatgagaggtgtcagcactgagagattacatttgactgaggtgcaggacaaagtgtgcactttgcacctgggctggaaaggccaccacaaacccttcatccagctgtgcttccttgcacctccaacccaagtagtgagcaaggcctcgctggctcctgctgctggctggctttggagtcttctatcttctccagcagggagaagatggtgttctgtgttagaaattagctaaacataaaaacgagtagaaaagctcatcaaaatttgcaaccttctatgtttttttaaagttcaaataataaaaatgaaaattcaaaggaagtggtaactgtttctattaataaatcagtttgtggacaacatttcaggtagctaaagttatttcctaattaaaattaggattgttttatttttttcaccttcactttcttctgaaagattttttttaaaacaggcatttgactacagaacatactaaatgtagaaaaaaaaaaaaaacccacatgtcctcagcttttattttgctgcaattgtactggaacttatccactcagcaaagacatctgtgtggaattagcaagactgaccagagtgggggcaggaacaatgtctgtccgattgtgcatttgtatgtctctttctctctttctttttctgcatttagtatacagtcagtccccgactcataatggtttgatttatgaattttcaactttatgatgggtttgtcaggacataacttcatcgggaagtccaggaacgtttctatttcaatctatctctactgaggagtcctgtgctttaggtgacaaagcaggtactttgatcctggtgttcttcacatagtcacagctggttagacagttcagttgcaggtatttaaggataattcaggtgcagaaatccagtaggttcttggataattttccaagaaaaatttctacaagaatgaattagactgcccagcaagaataaagagagaagagaaaacaggaccaaatcctgacacacactaacgtttcaggatcaccagaggaagaagaacctacagagtgagaagaaacagtgagataagtgaagttggtgggaaaaaatgtaagactgaaagcagggtatccctgaagcctgaagaagagagcatttcaagacagaatcatcgcaggtgtcaaacgctgctgagaagcaggtaagtgaagcactaaagagtggtcaacagatttggtaatgtcattttttcaaaacctttccacccccaaatacttgactctgtcgtttttagtctccacctctacttccatatttttgcaattaaaatggggagacggggacaggagatacttttatgatgtttcaagagtcttagaaatttgaaatctctaaatatgccgtcaacctaattcttgttaactctaggcagtaacaaaaactgtgggctagtatatggctaaatttagatgctgacagggaagaattaggaggagagagggaaaataataataagtgcctgtgttgtttttggaaactacttttatttccaactatggctttgggtagaccaaaacctcacagtaactcaatttcctaatctgcctaagtggaatgatgtttgctccaccaacaaaggccaggagatacatcttttagaattatttggtgatatattctaggacaagtagatgctgaacagaatctagtggggtgaataagactattttcctacctcttcattcctggcccacatgtagttttacagtagctttgggctaccagaggccctaggcccaaaacttaggccaactctgctcctacccctgccacataataaaccaggaccccggcctagagttagaaagactgtattcggctgggcgcagtggctcatgcctgtaatcccagcactttgggaggccaaggcgggtggatcccaaggtcaggagatcgagaccatcctggctaacatggtaaaaccccgtctctactaaaaaatacaaaaaattagctgggcatggtggcgggcgcctgtagtcccagctactcaggaggctgaggcaggagaatggcatgaatctgggaggtggagcttgcagggagccgagatcgcaccactgcactccagcctgggcgacagagcgagactccgtctcaaaaaaaaagaaaaagaaagactgtattcatggataaggaattgttcttttatatatctcagccttgtagtcacaatgactctaaccacccagaattgttctgatattttacacataaaatggatgccaaggccaggcacggtggctcacgcctgtaatcccagcactttgggaggctgaggcgggtggatcacaaggtcaggagattgagaccatcctggccaacatggtgaaaccccatctctactaaaaattcaaaaaactagctgggtgtggtggcgtgtgcctgtaatcccagctactcaagaggctaaggcaggagaattgcttgattccgggaggtggagattgcggtgagccaagattgcgccactgcactccagcctggtgacagagtgagactctgtctcaaaaaaaaaaaaaaaaaggatgtcaataataataatagttaattttactaacaaatgggtattaggaagatactaagcttattaaatgtatcaccaaaacaaccttaagatagaggcatattatgactccattttacagagtagaagcctagagaggctaaataactcaacttggtcccacggctagtaagtggtaaagctaagatttgggatttgactcccatttcaagggccattgcttttaatcacttcacactgtctcgtgtactggatacaacaaacttagaaataagaatcagcaagaacctctaaccaacctctattttgtttccatcacccattccccaacacacctgtatctctcctcaacctttccccagatgactttcaattcactaacttttcctcttctatccatttcttcataaatccacttgttctccagatcagatgagaaacatatcaagaataaacaatttattaagtggacatatattaaataaatgtagtaggacatatattaaataaatgatgtctaagacttttcagcttcacccagaagggtcccaagatgagggtcattttaaacatggacttggcagctaccaaagatctacaaccaccatcgtaagaatgtagtttgttagcagtagacatatttcttttatccttacaaaatgagaacgttttattctcagtatctaaatattacgtagttcctggatagtaagttcatgataaagttacaaaccatatcaaaatgaaaaagacgttcctgttgcacttttggttttttcataatactttaaccctttgggctagttttcccaaggatgaatcaaagttatgcagagcggccaggcacggtggctcattcctgtaatcctatcactttgggaggccaagacatgcggattgcctgagctcagaagtttgagatcagcctgggcaaaatagtgaaaccctgtctctactaaaatacaaaaaatcagccaggcgtggtggcgggcgcctgtaatcccagctactcaagaggctgaggcatgataattgcttgaacccgggaggtggaggttgcagtgagctgagattttgccactacactccagcctgggcaacaaagcaaaactctgtctcaaaaaaaaacaaagttaggcagaggaagacgattcttcacagtcacatcaatactcgttatgcgagctaaaaatgtcacagatccaaatccttcatcatcactttgaagctgcttcaaaaacttggtcaccagagcttcccagactcctctggtcaagacaggagacgaggcaattccattagttgtttttaagtagccttttttatgacagtgttttctacatgtaaacttactagacttacagcttctttatgcataggattttaaaattagcagcttatttccattaaaattttgtgtctgtctcataaatgctagtgacgtatttgataacattagtaacatgaattaaatgaaccacagtgcaatttaaatattaaattttaatattaacatataattaatcatactataaatattttaatgttaatattttatactaattaaaatattagtattttaatactaaaatattacacagtaatatgattactatataatcatatgtactgttatgatactatattataataatcatattactgtgtatgtatagtaatattactatatcatagtaatatatgattactatgtaatattttagttaaaattgtgtcaacttacatacaatttactttggtcttataaataccataaataaatgtactggcaaactatgattctagtcaggatgggcctctgaggtcgagttcaaactcccatctcatgctttctaacatacaagcaaagaattaggagagagagaaaataataactaataagttctggagacagggagcttactgcttacaaggcatatggcacagctacgcagctcaacttctccggatgtccttctttatatgaagcctatcctcctctaactctccccacgtgtcccattctcttccacaggtccagcaatagacacatttaactcttttccacgtgatgcccttaagtcttcatttcctcaggctacacagtcctagcttcatccacagctcacatgaaataaatcagcgttattttgccatctcagtgactttattctggcctcgagtgtatgtttcagaacataaagtaagaataatgaaaaaaatatattaagatatgttcaaagaggggaaagcatttaatgctcagacttcttttcctttttggaggagggaggagaaaagaggtggataggtcccttttaagtccttttgaaacatgattctagggtgaggctctttagtcatctaggctagttattggcccagatgatcttcagaccctctgcaggatgaggccaaaaagtcttaaaagtaaattattcactcaaccatattatcaactttgctattcttcctctttcactattctaaattatggatcatgatttagtgatccatactactagtaaactgagtcctcatctctccctagaggatttctgggaccaattcttttgggaattattctttgtcctagttcacccttggtcaccacccaaaattcagcaccacacactaggcctttcctttctcccttcccaccacgtctttcaacttcccaaaaccacctatattactctcttccctcctaagctttcctcctgaggaccctgaagcaaaaagcctgaaacctagctccccacagaagacgctgcctctttttagaacactctcaatttctttggtggggctgaccttcccttggcccccatactctccaattccagagcatgatcttccaccacaaggtaaaactctggctcttccgaggcatatttcatcccctggttacattaatggtttgtaaccaggctagaaatttcttgagaaattgctttagttactactgaacctgaccccaagtagaacgcaaatatttctgaactagtattaataaattaatgctgaaaaactcaacaaattgttcagtgaataaattatacccatattcactccagggaagaaaataaggtctaataatctgaaagtctttgagattctcacagtatatctgaagaaaactcttcccatctttatgttttctagaggacctaagaatgaagggctctgcttacccaactcttggcatggggtcaggaagcaagattctcccgtagttactcaagtcagctccaagccgtcatcctacttataatattatgtatttctattgcattcattgcttattaactgtcttctacactggatatgtggtcccaaagccctcttaccccttaagatgacacctgcctgcagaccatattatacattacataatatttatcattttttatgtttttcccagtgccaagcaggagctgagatgaataaaaatcaatattcctatatcattgtttcgttgttgctaacattaggatgtgccctcttgcaaagaactatttacaaccatattatacatcaatagtgccacataggttttcaatgattagagttcacattttatttttataatttttttctgcctaataatgcttagtcatcttaagaattaaaataacgtatttcttagaagcagtttagttctttttaatgtagataaaagtctatagctctcctgagtgattcacttttaaacgttttattaaaatctgtttttctcacaacgattctttaggcaaaacaaagtcaatctctaaaccctttattctgggcacattactcctattatgccctttctggttaataagaagcacgattatttattactgagttttgatttaatttgtaaaaatctaccatctcaatttaccttggtaagattttgaacaaagaaatgaggaatatcaagatcagagtgtatttacatgccatttttctccagggaagaggaaagtgaattaataggaatgagggtttttaaaaggtggatgttttatttgctgctacttctaacacctcagaatcatggtaaaagacaaagtttgatggttacttttattgttaaactgaaagatttccttgccactgacaaactaaataccaagtactcgacgaattaccccacttaatcctaatcttatgatgtgaggcatgttatgattacttccatttaaatgacagaaaaacaaggctggcttttgtcttccagctcaaaggaggccaaggtgcaacttctttcagtcgtcctgaatcggattcatctgacacaagctgcctccaccatgctgctgaagtttgaccccaatgagattagagtcgtatacctgaggtgcaccgggggtgaagtcgatgccatgtctgcactggctcccaggataagacccctgggtctgtctcccaaaaaggttgatgatgacattgccaaggcaactagtgactggaagggtctaaggattacagtgaaactgacgattcagaacagacaggcccagattgaggtggtaccttctgcctctgccctaatcatcaaagccctcaaggaaccaccaatagacagaaagaaacagaaaaacattaaacacagtggaattatcacttttgatgagattgtcaacactgctcgacagatgcagcaccaatctttagccagagaactctctggaactattaaagagctcctggggactgactactgcccagtctgtgtctgcaatgttgatggccaccaccctcatgacatcatggatggcatcaacagtgttgtggtggaatgcccaactagttaagaagcacaaaggaaaaatttccataaaggttcatttgacaaggctgaacttacccaaaattatacaactaaatcgtaaggtcagagtttcaatcctgttctatggaaatcaaagctgaaattcactccagaacatgagcctcttctctattaggcactgaattctccatcctggagcctatatattgctttaacttgaacatcattttctattttcattctttgcaacttcttgcaattcagttatcagtatggcctaccatcagtatttataagaggagcaggatcaagtctttctgaaagttgctcacttctgtaacctgcttctctatcctatctaatattaacttttaaatgaaaaatcctgttctgttcatcaaaattaccatgaggtccaaaacaaaaacccatccaactgaagctacataacagctggctaacataccaaaggtcttaacatgaaccagtaaaatctcacaagaaaccagaattcattttggtggaatcactaaagaatgttttgatttaaataaatgcttatctccttacaccttatacaaaaattaattcaagatggattaaagacttaaatgttagacctaaaaccataaaaacgctagaagaaaacctaggcaataccatgcaggacataggcataggcaaggacttcatgtctaaaacaccaaaagcaatggcaacaaaagccaaaattgacaaatgggatctaattaaactaaagagcttctgcacagcaaaagaaactaccatcacagtgaacaggcaacctacaaaatgggagaaaattttcgcaacctactcatctgacaaagggctaatatccagaatctacatgaactcaaacaaatttacaagaaaaaaaaaacaaccccatcaaaaagtaggcaaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcgttcattaaaaagtcaggaaataacaggtgctggagaggatgtggagaaacaggaacacttttacaccattggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattgtggcactattcacaatagcaaagacttggaaccaatccaaatgtccaacaacgatagactggattaagaaaatgtggcacatatacaccatggaatactatgcagccataaaaaatgatgagttcatgtcctttgtagggacatggatgaagctggaaaccatcattctcagcaaactatcacaaggacaaaaaaccaaacactgcatgttctcactcacaggtgggaactgaacaatgagaacacatggacacaggaaggggaacatcacactccggagactgttgtggggtggggggaggggggagggatagcattaggagatatacctaatgctaaatgatgagttaatgggtgcagcacaccaacatggcacatgtatacatatgtaacaaacctgcacattgtgcacatgtaccctaaaacttaaagtataataataataaaattaaaaaaataaaatattttgggtccataaaaaaaaaagcttatcttaaaggatgcttaaaaataaacaaatgtacagattgctttaagaaatataaacctgctcacataccacaaatgacaatagttttgagggtctggggttctcttcagtaatgtattctttgagatggaatcttgctcttgtccaggctggagtccaatggtgcaatctcggctcactgcaacctccacctcccaggttcaagtgattctcctgcctcagcctcctgagtagctgcgattacaggtgctcgccaccatgcctggctaatttttttgtatttttagtagagacggggttttgccatgttggccaggctggtctcaaactcctgacctcaggtgatctgactgcctcggcctccaaaagtgctgggattacaggtgtgagccactgcatccagccagtaatgtcttctttttaacagcagcataatattccactaggtgggtgtgctatgatttgaacagtcccctttttgacggatgtgtacgttcttttccatttttgctatcatacatgaaacagcaatttaagcctttatacacacagttttgcacacctgagtatatccacaggataagttcctggtacatcgaactgcattccatgtagcgtctgcctatcagctgacaactctttgagctaggacagatataaatccagtttgtaggcagtatttagtcactgctcttcttgttatctggcagcagatgaattaactaattccccaaaccaacctagccgttgaggacagaccagggggtagtccttgtaaccataaccctaacccataaccctaagttaccctattattagactagagttccctagaagcaaactggaaaggtaggagtggctagtctcacccaacctctttgttacagagtcccagtgaaaagcagggatttagataccccaattcccaggctgtcaatcaattctgtaaaagaaaaaccagcccaacagaaatagcccatttccaagagacacagacaggtctcccatctgacctccctgagtgaggtctcagagttcctttgaatatgttatactcatggcatagcagtaccaaccaaggaaagagatcctggcaagataaatcactctccatcccacacgcccttcaaaataccaaatgccaaagagttgatgctcccattcttccaaatatttcactattctctctagggggaacccatccacagatcattataaataaggattctgtaagtaagaatgcttttagtttaaccaaaaatccagaaggataaatatataaaatataaagaattggtcacatctctctttcagaaaagactcagaaagctgttcaaagggaggaaatgtttctcttctacttggctaatttgaataatattctgatatacagttttcattacatttactcctacgtgaagatgaactgagcaacaagaaaaatccatattattaagtcattcagaacagagctctcagttactataatacaggcaacagggaaagtaccagagattaagggataagccaacactgccagtgtctccccttgttgaaaaagcaccaagatacccggatgcattcacttaaaagaaaagtgatcacttacctgcttctcttttttctgtattttcattttcatctattgaaggaagatatttatttctgtaaaacatttttaaaaaggcaaagattatgacaaaacccaaaataaaacattttcaacatctccagattactgtaacacacaaggaaaacaaacaggggattacttctgcagaacatttatgtccaacaacctccagagccgtaagtgtacacctaattagatctaactctgttagaccctaatttattgcacccaataaaatgaagtcaaaaagatattgtctttgtagattaaatcagttataaaagatgttggcatgtatgaaagttagtggtaaccaataaaggaacaaaaacaataacatgcctttactgagaggtattaggagatgggaaggaagtaaggtaagccctcatcccttttggaagaaaacaatcaatgatgtctacaatggaaaaatcaagaaagagaaatacagacaataaaaaagagctaagagttcaatgcagttctctctaaggagtgagacaggatttggtatattatttgacgatttaaaccatgtacatttattacttgaaaaaacaattccattgcaatatttcatacgattttttttaaaggactgattttactctatccaggacataagcccccatccccactgcaaccataatgtccttgacaacactgaacttctcataaatgacttgtgaacaccataaaagcccagtaattgtctttagaggtacaaaagtgtgtcggggcatttcagggaaaagaacaaaccctagtctaggaaacccagaatttggggctgcctgcatcactaactagtactactgcctcagatctgaagctcttaccttcctcatatacaaacaatacaaggattatagaatctcaggcttctagttctagccggaatataaacactgcttcctattttttgttgactttgatttcctgttcatcccacacaactacagaacaccactcactcagaaaaccaaattacccataagtttcctaattatttctcatatccaaatgaatgtgatgtgtaggcattaagtcttaatagagcttttaagattagagctttaagattaaagtgagataagtatttgaggtggtagatatgttaattagcttgacttaattattacacattgtattcataaatgatgacatcactgtgtaccccataaatatatacaaccataatttgtcaatttgcaatttaaaaaagattaaagtgagatagttccaattctaagtaagttcatggcatgttggacgcaaacagaaaaatgaaagacatgattccaatcatccttgggaccgcaattacagtttatcattttaatgtctgtcaatttagatttttctccctctaagagttagaggcattttctattaaaagaaccacaaaatgccatggaatctgtcctagagagacatgtctaccaaggtactgctgtttgcaaagagtgcagcggccaaggaggtaagtagttggaaagcaggcatgatcgggtgctaaggtgaaggggaggagggtagagactaactggctaaatcagggaaaggcaagtccagttagtaaatggtgcttctaagaatcaatgcaagggttagtgtttgataggacagttatttacctgaagaatccataaattccagataaatggtaagtgctctgaaccaacgcagttaaaatttagaaaaaaattatctcctaagcttcattacagtggagtcagttgtaggtaaattatgttagtacaagtttatctcctttatctctattctttaaattatcagaccccagaaaactgacattcttaaccatcacaaactgccacaaagtcaaaaataaagaagtttgggggaaaattccagctaataaaaaagggtattaacaataagacatacgtgtagaaagtaaagagtttcctcttcaaagttccccttcttgttaaagaatgaatcataagtgttagaagtagtagtttcttttaaagactacctttcttcaagcctccttggtttgggctaataactctttgtcaggccctgtcctaagtaactgttggacatgctcacaggcacgttccagctcatagcctatgcccattccttatttggaaatgttattgcttccttaaacctttcataagcaacttcctctccttctttgttcttccccacacttacctatttaggaaagttttaggctattagcaaatcgggtattagtttaagagcgtgaggtctagctccagccaatggatgcaggacacggcagtgaggatgatccaaatgtgtaagggataaatacatctgcttttcctttgttcaggtgtgctctcaccattgtttcatctgcgattgcgtaccctttctgcagaaagtaaagatcgccttgctgagagatcttttgtctccgtgctgacttttctttgtggcactgattatttctaacaattttggtatttctaacaatatgtctcaaataaaattctgcccaacaaaatgaaatcattaaaaattacagaaaggtcaggtacaatggctcacacctgtaatcccagcactttgggaggccaaggcaggcggatcacttgaacccaggagtttgtgaccagcctgggcaacatggcaaaaacttgtctctatagaaaatacaaaaattagccaggtgtggtggcttccacctatggtcccagctacttgggaggctaaggtaggaggatcatctgagtctgggaggtccaagctgcagtgagatcacactactgtactccagcctaggtgacagagtgaggccctgtctcaaaaaacaaacaaaacgaaacactacaggaaaactctaccaatgttaataaaaaattacttttgtaatgtataaagaactgatacaattatgatgcagcagggacatcagaaagcacaatttctgattcactaccacaaactagcactggaataaaaacaagcagggcacctaacactgccaggaatgtgggaaaacaggtcctacttataattgctaatggcacttttattttttatttatttatttatttatttatttattttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtatttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggataagaatttttcttagtacagaacaaaatgaaaagactcccatgtctacctctttctacacagacacggcaaccatccgatttctcaatgttttccccacctttcccctctttctattccacaaaaccgccattgtcatcatggcctgttctcaatgagctgttgggtacacctcccagacggggtggtggccaggcagaggggctcctcacttcccagtaggggcagccgggcagaggcgcccctcacctcccggacggggcggctggccgggcggggggctgacccccccacctccctcccggacggggcggctggccgggtggggggctgattcccccacctccctcctggacggggcggcttgccgggcggggggctgacccccccacctccctccccgacggggcggctggccgggcagaggggctcctcacttcccagtaggggcggccgggcagaggcgcccctcacctcccggatggggcggctggccgggtggggggctgacccccccacctccctcctggacggggcggctggccgggcagaggggctcctcacctcccagtaggggcggccgggcagaggcgcccctcacctcccggacggggcggccggccgggcggggggccgacccccccacctccctcccggacggggcggctggccgggcagggggctgacccccacctccctcccggacggggtggctgccgggcggagacgctcctcacttcccagacagggcggctgccgggcggaggggctcctcacttctcagatggggctcctcacttctcagatggggcggttgccaggcggagggtctcctcacttctcagacggggcggccgggcagagacgctcctcacctcccagacggggtcgcggccgggtagaggcactcctcacatcccagacggggcggcggggcagaggcgctccccacatctcagacgatgggcagccgggcagagacgctcctcacttcctagatgggatggcggccgggcagagacgctcctcactttccagactgggcagccaggcagaggggctcctcacgtcccagacgatgggcggccaggcagagacgctcctcacttcccagacggggtggcggctgggcagaggctgcaatctcggtactttgggaggccaaggcaggcggctgggtggtggaggttgtagcgagccgagatcacgccactgcactccagcctgggcaccattgagcactgagtgagccagactccgtctgcaatcccggcacctcgggaggccgaggctggcggatcactcgcggttaggagctggagaccagcccggccaacacagcgaaaccccgtctccaccaaaaaaatacgaaaaccagtcaggcgtggcggcgcgcacctgcaatcgcaggcactcggcaggctgaggcaggagaatcaggcagggaggttgcagtgagccgagatggcagcagtacagtccagctttggctcggcatcagagggagaccgtggaaagagggagagggagagggagaccgtggggagacgggagagggagagggagaccgtggggagacgggagagggagagggcacctttttttttttttttttgagacagtctccgctaatggcacttttaactgtttcaagctttctgaagagcactcaggcaatgtgccactagatctatgaacgttttcaatccttttataggccagttccactttaaggaatatctcctaaggccataagcgggtaggaaatgaacctgacccctaggggaaaggtcagagatgaggtgggtgaaatgtgaaaatatcacatcagccttggctagcctctgaggcagagagaatgtgcatgtgaaatctgaatgatggcgatgttactgtagagtaactgtctagttcactgaaagcagactctggcaaatctcatgttactgtcaaatcatttctggcaccccaacagatcacaaaacacaccagcatgctgccaccccacaagataacaaacgtcatcaacatcaataggtgttcaataagcatttattgatttgtccttctccagacagcaccccataatttataaacacccttaaattatctctactttttaaatctttttaaaggcacacattaaaaaatacataaaacaatgtcatctttttgtaaggctaaattttatgtactaggaatagatgaatagatacaccctaaagcttgtacttctgcacaatgctggaaatggctttacagtctctgctgccatcactcagaagttctgactagatccttctggctcaataaagaacaaatcaaaatgtaatttcagggtctcaatacttaattagaaacataatacagataattctacagataactccgtgtgggcaaaccagaaaacttgtcaacagcggaaaatatcaagtgtataacttctgaactggggaaactggtgggaagctagtgggactcccgctctccttgctgcattatgtatgagtgcttccgtaggagcacggcatttaattatcttcacaagaaggtaagctgctaatgatgtgaaaacaaacaatataaaagctcccattcctcttatactcacccatctaaggatgctcctattaagaaaaatgggtgccaggtttcaataagaacattttgaaagttttcttttctttttttttttaaattactatctctctctccagtccaaaaaatctgcaacagtgcctgtgccatttccaagttcctcagtgttgtgtaatagtaacttttaaaaaataacaaaaaaatcaggttcaccctattcaaccatttattcacagaaatgatttaaattcactataccttgagaactctgccatactaacaatccctgctcagtccaagggtcgactgcattacaagagtgtgtgtttttgcaaacacaaacaagtgcatacccagcagacccctaccaaggtccttcatattcacagaagatgagagtagactcaactgaacacaataacgatggagaattctgctgttaacaggcccctatcccccaccactctatcaggcactttgagacagagtatgtgggaagcaactctaaaaatgagacccacctcaaattttccacagtgaacatgtatttttataatctactcatgcccatcctcaaccttgagattgtttcctatgaaccactctaacaacagcaggcataaatagggtataccatggggattttaggaatacgaataaggacacagagagtaactcatctgggaagagtgagataatcaagaaagcagagatgtcttgaggaatgccaccttccttaaacccctgcccaaatacctcttatcaagactcctgacctcggaggcagtccagtgggtaagaaatcccccaacttcccatttccccaccttactaccctccacgcccacaaactggacacatgtacctttctctattgccaggtgtgagcagtctacaggaggtactttaatagcaaggggttgaagtaccagaaagcagtttggatctgggctgtaatgacgacgagacatgtgaatgtcttctcccctgtaaaatgctgacaacatgtgcctcagagggcctcaggagaattaaaagggatggcaatctatggcgtctgccacatggtgaagactagctataggcagctatttgtgctacctgtccttatggtcatccctccagtgtcacaggaagaagacgtaaatgacgaagaagatgttttaatgatgtaaaaacaaacaatataaaagctcccattccttcttacactcaccatctaaggatgctcctattaagaaaaagggtgccaagtttcaatcagaacattttgaaagttttctttttttaaattactcctctctctccagttcaaaaactctgcaacagtgcctcatctcctggggacaagtaacctttccatctgtatttgagatccaccctctctcccccttctcagtcacctcagtctcttgattacctcccagttactctttcctcatttcattcaggactctcctcaaatatcaccttagcagcaatgccttccctagccagcctacagaaaacagcacccccacctcccacccaccaccactctgttactctcttattctaatttcattttcctccaccaggtacttattactccctgatattatattacagtaataccttacttaatgtccagactcttggaaaaagctacacctttcagtggaacaacgactttaagtgaaacaacttaaggcaggtcctctaatcaacattatttcattacaatgttgatgagaaaaaaaattagtttccttaaatgctgttttgcttaaagtaaggacttcctatgtatctatttggttttaagcttattgcctgttcctgacacacacacacacacacacacacacacacaaagtaaactttgtcttgttcatgctatactccctgagtctggaataggattgagctcctagcaggtgtgcaataagcattctttgaatggaagaatcatttcttctccctaagttatcactaaatgtctccctttgtatagctctcctcctctcaagaaagaaacaggtttaactctatctcaaaacagtaacaacatgaacaaatcctctacacacctgaaagttcacttcctcccatattacttccctaaagctgttcttgacaatcactccctagttaccaaacctaatgggcatttttaggctttgagtgctttgcagcattttaaactatggaccatttcctcttcttaaaattctcatctcactggtttcttgatccctctgattgcaggcttctaggcttagcttcctccctagaatcctcctattataaaacccaatccttaaatatcactgttcccagggttcaatgctgtcaataccagaaaggctccctgagttttctactcaactcccaaacttcatctctttgcacaatgaccactgcacatttgcaaatccaagccctcctcttgacctctatgtggctatatccaaccacatcctggccagttcctgagacattccacaggtaccaacaaagaaccccacaactcttccaaaacgaaactcagtaccacctttacacacacacacgcacacatacacacacacacacactctctctacctgctcctgtgttccccatcagaggttaatgtcctgcaacctgccatgccacccagcccagaactgagttatccttgattccttccctttcccgtaactcctttaattccagaatcccttggttcctctccagtcgactccggtttattcccatatatttttgttgtcatttttgcctgaaacagcctcttaagtgcttctctattttccatgtctcctaccctcacccccatcaccctcattgctaccaacagtatgttttcctaaagtgcaaacaaaatcagatgctatctcttcagtgggtattgtgtcttaaaaaaaataaaaacatattcctcataacacagagccctgcataagcgatctggcctctggttcttgtctactgctctgacattatttccaccattcatccaactatactgaacacctgtgggttccgactcctgccctgctcattcaggtcttattcaggccctgccttgtgtggtctcatccttcaaaattcagatctggtgtcatgttctccgggatgtcttccctgacctgcctaaatctcataagcatcttgtgataggcactaaactaaagcagctgtatcaccatgttattatcatcttttacctgtctgtgcatgccattagctgtggagggcccaagcaccctccagggagggaccctgtcctgcagtgtagcactcagtgcctgacatttggactcttcagtgattacctgtggaatgagtaagtgaattaatgggaaagctgtgtttactgaaaaggctttgaactactttcaatgtaactagtgacctcttttttttttcctcctaatccaatcaaatttctcagtattcttccttcacaccttttcaaatacatgtacttagcttaagaattcaatagaaatataaagcctaaaacaaataaaaaaaaaaacagtccccgattctactccccactcctgattcactattcccagaggcagtcatttaaacttcagctgttccttctgctcctttccattctattttaaataacatggttattactgctattagattttcttttcgattttaggcattattttattggcttcttcctatggaacaggagtcagcaagtatttttataaaaaggccagataataaatattttaggctttgtaggccatatggtctcagttgcaactactcaattctgctgtgatgtgaaaacagccatagacaaatatgcaaacaaatgggtatggctgtgttccaataaaactttttttcaaaaacaggaagtcctcctactatagaagatgaagtgttatcttcccaatatagttattatcacccttatttattaaatcaacatttaattcacagctaagccatgaactatactttgctgaaactttgtgtcatttttttccctgaagataataactacctcatttaaaaatttgcatggttttctatgaatcactaacttctcctaaaatgctcctctaaaaccttgaaactcctttcaatctaagctcaatgttcttctcttgggtcattataggtagagtcctccatcaggagtccttcatcattgtctctaatctgcctcctgggacttctcctcaccatcctcccagagactcactccctcagtctctctccatggtggactcctaggtttctcctctctaggtttacactctcattttagtgaagcacaacatctagtaatgctctagaaaatcctaaaaatgagatgtaagtttttaagaccttcatgtctgaaaatgtttctattctatctggatggactggtgggttgcaaatcacaggctggaggtcaatttctccttggaattttgagagcactactccattgttctattccttccaccacttattttgaagaatctgaacaattctgatttctgcccatttgtatgtgacatctcttcctttttggaaagcttttagaatcatcttttcaaaatgatgtgccttggggctattttcacccatgaggttaggtacctggtggattctttctcaatctggaaactgtcagatttttcagttttgagaattcctctggtattatttcttcataattccctccctattgttttcttttaatggaactcatgttactatttgaatgatggaccttcttggctgtacctctaattttctgtctcatttacaacaaaacaaaaaaaaaactcttcatgttctactttctgagaagtttcctcaactttctctttcaagccttcttttttctttatagctaatatgtttttaacattcaataattcttttttgagtgtgctctgatattttatttttatagtctcctaaactcatgtcaactaaccaataatggaagggcattcaaatgacaaatggttactcttttctttcaaagatgaccctgtggtctagtggaaacatttctgcacaaccagaatactcaaactagcatgaggaaaggcttctgtaacagttttaaggatttctcatatattcaagctctggctgagaatatttttgccttaaaggtgccagagcaccaaaatatactgagggtttgattttttttttttgtattatgaattcttttagatgcccaaaagttttctttgaaacatacggcaatttgtaaattagatcaacttcggtgaaaaattatcttttgtgtataagtcaggcaaaagaaagtctgtataggtaaatttctgatgttctctactacaggctagagaaaacctatcaccttaaactcaagacgacatgtcaaaaaatatccttatctgtaagattaaaagagggccatgaggacagggaccgtatctattttgactattgtctaactaatattagcatagtatttgataaattagtaaatatactaatagcatatatggacttatcaatagtgggtcaaaagagaaagatcttacacacagctgtaaagcttggactaaaaatccatctctccaaaaatgtgaacacctaacttaaaatatctgccaaatattacttgtgagaaggcactagtactgtcatcacttccaaactgaggaagctctgtgcttggccggtctgaaaggatgcattaccatcattaacattaagactctactcctcaaaagaagtgttttaaacattcaacgaattaattttagagtaaaagctctgttaccctgcatgtgggtaatataagccaaaaggcaaatcaacagtagtgattttaatccttgtctgtgaggagatggcaaaagccagtagtagaagtgacaacaacctcctaagaaactctcactactgaaccaagagtattaggaaagcccattctgagaaccttcctgtgggccagctgctgaataacaaggcttttactcactgaatgactctcctctggctattcaaagtaattactattaacttgaagcagtatcctatgttgctataattcctataacctgttttacctgagatgatataaaggtataaactaaggaagctttctatagtccagaaatacctcaaacaatgccacattcgcacaatcagaactgaatgggatctctgaggtcacatggccaaactctttgatttcagtgatgagtgaggcacattcgcacaattcaagaggagaaataccaactccagttcatcttccttggtcagaaaaaaatcatttctaaatcctaatctgctcataaaaatcaattagcttgataataattactattaagaagaacagtagaagcaagtggccagacccttctagagctatcatatatcacattgtaaggtaaaatctgactgtacttttttgttgttgttggtccctatgtcataatgtcaattgacccagatcaggaatgaacacagctgtgaacacaggactgaataaaccaatttcttgacagccaagcccattcaagcttcagagccctgaaaattcaagtcataatcttatgggggaagacaaagggttttacaaacaacactctatatattcagtttcaagaggtctcaccagtaacacaagaacttttcactcattacattttaatgtcttttgtggtagaacagcagtacctgtagacttgggagtgaagatatctgggttctgaacacaagcgttgtgggatttgggcaacttatttgatctccctgggtctcagtttcttcatttacagaactggtacaaaagccaatcatatgagactgacacatgggctaaaaacaaaaagttactctgttaacattgaaatgagaagccatctacaaaatagcttaaacatgttttggggcgctaaaaatgatctagatgacattttctcttcccgttttccaaaacagcatataagacacaaaaaactcacaactcccaatgtaaactccctcttgggggtattttaaaaacagagttataaaaaagaacaaactacttatacacacaacatggatgaatctcaaatgcattatgctgagtgaaagaggacaaattgaaaagtctatatactgtatgatttcatttatatgacattcaagaaaaggtaaaattgtaggaacaaaaaacataccagtggttggggttggggacaggagagggtcaactataaagagaattttaggggataatgaaactgttctatatcttgattgtgatgttcattacacaacggtatgcatttgctgaaactcaaagaattcctcaccagaaagcggacatttttccgtgtgaaaaaagttaataaaatttttaaaaatcttacttaaaggctatgttaatccaaagttaatgagtaattcaattaaaaaattgttttctaaacacccaacatgtataatgggtgaccaataggtgaagaggaatcagcaaaggcaggtgaagtttggggctggagataagtgatggagagaggctctcaaaatgcctggctaggcagtttgaattgaatcttctatgtaatggggagccattaattgaagatttctgagaaaaggacaaaaattatcaaagtttgtttgatgtaaagattcatcaggtaggaataggtagggcaggcttggggtccaagaagaccagtgagtcatacccaggtagaagtaacagtaaacagcaggctagcaaataaaacagaagagaagtcatggagtccaagaaaatgaagataatggattttttttttttttttgagatagagattcactattgtcacccaggctggagtgcagtggcgcgatctcagctcactgcaacctctgcctcctagattcaagcaattctctgcctcagcctcccgagtagctgggattacaggtgcctgccaccacacccggctaatttttgtatttttaatagagacgggttttcatcatgttggccaggctgctcttgaactcctgacctcatgatccacccgcctcggcctcccaaagtgctgggattacaggcgtgagccaccgcgcccagctggattctttttaagtggcctaagatgctagaatgctggtattggcaagaggcatcagggcacgagaaagaggtaacttttgggagagtagatggataagttctattacagacaggctaaatttgaaggaaaagtgaagactgagtcacagtgagaaagaatccaaggctcaggcaatgtaatccttttatcttaagataatgaaacttagggttagagctgtcaaatgatctgcccaaagcttcacattgactccgaagtacaataattagatttcctggattccaattcggctctcttagtactacatcaagctgccttgcagacaaatgaaaataataaagtgagagatcaggactggaaatgttctatttggggcgctcagagagtgggcagaggttggaaaggtattctacaaatacaacagtctagaagtgcagcagtaaagatgaaatgaaattaacaaaggctgaccaatgataaatatcattctatggaaagtgggagaacaagtacaaagagaattctaacttttctagcctgggagactgggaagatgatattagtaccattaagagggaaaaacagtcaacaggaagagctggctccatggagtaagacaacgcatttggttttagacatggtgactctgctgacatccatgagaagcagttctcaataatggctgaagcacattaaaaaaaaattcactcccatctccaaaagattccaatttaactggtctgaggtgacaccccacataattttctaaactctctcagatgactctaataggcagccaggttggaggacctctactctggaaaaacatccgagcagaaactcaaccatgaaatcactatgccatgtactctccctgacagattgcattttctagtacttattagagagtaggtagggggaaaaatgaaggggcagtgagatagtgagggaagggataactactagcttttggggggaatggaaaaaagtctccaaagtcccacacaatggtttgtgtggtgtaaagcctaaaattcaggcccaatattatgtgctgccttggtatctgaaactggaaagacctccaatggtctatccccaagttcccttccccactctgctcctgtggataaggtcccctaaccaaacctccatccttactgaggggaccatgtgcagttccttcttatgcccaagtagaggatttccatttcttgccagcctgtagaattactcatgcaagtcaatcacatcctcccatgggaaccaggggtcaccccgtcctcttggtactacaaagcctgcctcccatagaccctggatgttcacccttttcccaagtacaatccctgtgtggccctgggtggtgtgtggtgtctcctcccgcaggctatgagtgtacgtgaacaataaactgctgctgatctcatctgcccagtgttaggtgtactgtgcttggtcatccctataatcctgtgtcaggaatctcacacaaatggggtgaataggaggtaactaaagcaaatagcatcatgaacaagagggcccaaccgtgaccaaggacacctggttagtttcaacttatttctcttagctaactaactagttccattatatggtgaaggccacatgggacagaatcaccagttgctgctgggcttgcactatggcctacacagctcttaactgtctttgttggatgttgtcatctcttcccaccctaaaaggcacttgtccccaagataagactctgttgttaattgactgtaccctggtgtgatgcgccatcaggtctggcctatgtgtggcaggtgttctctgaggctcctgcctgtaaagtggtaacaacacagtgccttaaccagtaagcacttaagtcccccttatcaagggtcaagctacagctcttcggtcactgtgtctagcctgatgaccatcactggccacttggggcaggcatacacacactgtttatgattgtgtaccccaggaacaggctcagggacagctgttaagtttttggaaagggagaccaccaccctgggggagacttaagcatggctccttggttgtgtagttccagcaaaggtagtggtggtcttgcctgtctcctgtgctgctgcttcccttgctgttgtcatgtacactctcctgatccccaagtaggtatcagtgtgcacgtccatggtggcttgtggttcaggtactgatgaaaaaaaaaaagggggtgagcatttggtaccaggccctcccaaaacacaggaagagagaagtcaaatgctcttcccatgtgaaactcttaacgtgcctgggctctgctcagttctgctgcttaccagcatgccaaggagctaattttatgttcacagggctcaataagccccatccaggccacagacaaaatgaccttgctggatgtggactccaacccaggaagattgactggcactccctgaaggaacacaaggctgctatgaggcgggcttgcaggctcctaaacctctccctgtaactacacagatgtctacagcatgagtgactggatggagacaaacactgaaaatcatactctacatggctaaaaatccaaaatattctgagaaaatatgtaaagagaaaaaagaataaaagtaaaaaagcaaggctgtagcagaggatggtttcaatccaagggtgaagtacacagaaagcaattaaaatagcttgataaaactatcatttaaaaggaccatataagcacattttagacaagatagatagatacttcagataatattacttgatacaaggaaacaaaatatttcaaacaaataactcatataattaaacacagataaaatcttgagggatataaccgtacataattctgtttaaattctttatctacattcatatagccctccatttgaattctgaattgttaaacaaaattgttttggatcaatttatggtaaggaacaaagtttatctgatagctatccaagatggcagggaaacaaagtaaacacattaacaaaattataacagacaatacttagcagagaaaagtttgtactttgagataattaataaaagaaaaaccacatatttatggttgcccaggctcagcactcttcaatctacagaaaacagaagagttggcccaagtggcaagtcaatctataattggaaaacagctcctcaaccaaacctgtggaattcctagcaataaaaagatgggcttcctcctataactctgctgtattaaagtaaaatttttaaaaacccaatatttttccaaagtgtttttttccctttgtttaaagagaagacacataatggattctgaatctgacacaaattccttccattcaggttttatggatgaaatgctaaaacctacttccacatcctacatcaaattacctttgcaaaccaagaaggatgctgcaccctgatggcttccacagtcatttctgcctcctaagagctgttcaactctggcacctcctgcactttccttagggtctgagaatttttgtttaatataaattgagaatgtttttcaaactctggatttttcaaagatgagtatcagttcttaatcccctcccacttccaattcctccttcctagaagcctaagagggagggagtactgaggtaaacacaaaactagtctgttggggaaaatacatagagcaggacatggcatgaggtgaccaagaggtatggaaaaagttctccttgcaaaagcaaacagaaagctctgggtgaatgatgaggcaggtggctagcaataggatcctcctgccaaacaaaaaatgtcctggttctcccaatctggttgtagtacactaaaagcagaaactgcaggcaataagcagaatatttaggaggccactttaggccaacttaagcccatccacaaaaatctgttaacaccatctacaccatatgtgattcatttaatttgcctacaaattggtacagacttggtcacctactttaaactcatactatattagcaaaccactactaacttctaatacctaaataaaactagttgtttgcctaaaagtgaagttttcagattggcatggggcactactttagggggactggtctgagagatgacagaattcatgcccagaatgagcacaagaatcacagaataaagcctgtttgtttcttggtaaacagtaccaatatccagatcaaaaagtaaccattttataacataaacttaacttcttaccatgtatcacctcctgcatatacagtcagccctccacatcctcagaattaaagatcaaaaatatttaataacaataaggcaattaaaatataaaatttttaaaaatataaaaatacaactttttaaaatacagtacaacaactatttacatatagcatttatactgtatcagagatgatttaaagtatatgggaggatgtgagtaggttataggcaattactatgccattttaaataaggaactggagcaacctcaaattttggcatgggatgggtgtcctggaaccaatcccccatggacactgagggactactgtatttatgttacctgttccaatgttcccttccatcatcagtccaagcactgagaaccagctccaatggcatgatttaaggtttttctagatacagatgaccagtttggagtacaacaaatttccaaactgccactctagaatacatgtgcagaatgagactcatatcttcaatcataggcaccttttctcaagatgttaaatttgaaaatgacagtctttactggtggcagtacaagcccagactaataataaaatgaaataaattaaaagtcagtgaactctcattaggttgaatatgaaacccaagtatcaattcttaaaggctcatcaaaatcctcaaggagttggtgcaaagctgggtatcacagacaagtgatgcaggcagccctcaaagagaggaatataaaataataacactcagagggccaaggaactgcccagattcacctttgtgaactcagtatctaggacagaccaataatgtaagtacagtacacatatactagttgggcaagtaggtggaatgaatttatatatgaggggcccactggctaatttcaccacttatgctgttttcttccttcacccccaaatgacttaagggttaaagattataaggaaacaatttttacaaggcagtcattctagattctcagccttctgtgatatgtttgcagtaactcttgccctggccaaatcctctctatgtacaagaataccaccagctattgaaagcacaaaacaacctcatatgctgtatactgggagatatcaagctctgtccacaaaagtggaattagactaatgtgactcactttaacaactgagctttaagcagctggctccactttgaaattcaccctaaattctgttcacagtgtaatgccagagtttcttaacaacctctgttttctgtgaacatgaactctttctagattccatatccatcccttggatccagattcaactgctaacttggtagattccttagcttctgctctcagagttacctactcctgaacaaataacagtactgagctgcttctgcttgaagcttttaaaagctacacactgagtctctcctatcaccaccagttcccaaacaagtctacagttgttgttatcattaactcctatatgggagttacagtgggattccaaatctcttagtgaagaaaaagaaggtctggtgatttgtcagctgtgagaaggatatatcatgacaaagataaaagcaaagacaacgcttacagaagacagcagtgatattttatttagaccaagaacaaagaggtatctgtgaggccataaaaaagcttagaagttgctgcttaaagtcttggtaagaagaatgacagcaaaatgaagaagtgtaagttgctctactgacggcttcagagttaccaatttgataccaaaagaaaggaagtctggccattaattttttttttttttttttttttagacagagtcttgctctgttgcccatgctggactgcaatggcacgatctcagctcactgcaccctccacctcccggttcaagtgattctcctgcctcagccttccgagtagctgggactacaggtgccgccaacacacctggccaatttttatatttttagtagaaacgggtttcatcatgttggccaggctggtctcaaactccttggccattagtatttttgttgaatgaattagatatctatttttagacattaagttagacaaccttcatatggtttttaaacattaaaaaaaaaaggatgagataccctggattatatttcctctattctagactggatcttgttttaaagcttttactttttgaatcaggttacaccatattttaaattttaatgaaatataatagacattataatagaaagcacagctcttcacaaactgcacacagctgtgtaaccagcatccccatccagaaacagaacattagcactacaaatccatactcctttcaatactgcttttccccaaaagtaaccactagcctgacttctaacaatgtagattagttttacctgtcctgtgccttataaaagtggaattatgtaatctgtgttcttgtacttagctattatttagtcaatactcttatatttggcttctgtgccagttatcaatttattgcctcttaactccaaactcacccttcagtactagctctgtaataatggactggactctccagaattcctcctttacagagcacatgatgctaaacctggtcagcagaggcagctggagggacaacgcaggaagaagggagcttgtcttttgggttcaaaagcgctgtgcttttgctgttcttgctcttgctccaaggtctagtgtaagtatgtggggacatatggtagtgttctgcctaccacatgcacaaagcacaaagcacatggtccctcagtgacaccaggcctggtgaccaccttcctgtgctcctgtagacacggacagcagggactccaggcctcacacacacaatagcctcctgatggcctctgctggcttgtatcccagagagttgtttcctgcagccctcctaaaaaggatgccatgtaccacttccctctgcatgcccagctaccaggcctggctcatctggaacccaaagcgttgtttaacagggccttcccaatgcggactctgcatgcctctgcaccttgtagccacagcggcacccaactcccttctgcatgcctacccatcaggtttggtttcttgcttgcccagcaactgtgtattaactctggcccaggcaagcagggaactcctctgccacccaatgggctacaaccacacctttaccaattaaatctgaaccctaaccctgggaaaaaggtcctcttatcccattcagagtataaataattatctgaagttattcaactttaataactaggagagcttagatctgtacttgggacagtataattctaaagctcaagaccctttttttttttagactgagtcttgctctgtcgcccaggctggagtgcagtggcacgatctcggctcactgcaagctctgcctcacgggttcacgtcattctcctgcctcagcctcccgagtagctgggactacagtcgcccgccaccacgcccagctaattttttgtatttttagtagagatggggtttcaccatgttagccaggatggtctcgatttcctgacctcgtgatccacccgcctcggcctcccaaagtgctgggattacagacatgagccactgcaccaggccaagaccattctactaccaccaatctagaacagattaaggacatttcactaaactcttctaaattctatgaagtttgaggcagtgtcatactcgccactacctttcattacctagtatagtgcctggcacacagaaggtgctctgtaactatctgatgaatgaatgaagatcttgacattggaactacccattttatgcaacctaaattctcaaattccatgatttttagcctccatgtattatgttacacaacaaccctaactgggaaaacaatattgcagattattgtgattaaaccatgtaaacatccagaccaagtgacaaagaagggctaaattctgaaagttccaaattaggagtaagtgatacaaatatctgtgacccaagaaagagggttaagacctatgatctagtaaggaaggtaacactagcacacaagtaactggagaacaatgcaaaaagaaaaaaacaaaaacaaacatcaagacctaagctttaaaaacctaagagccatgcgagttaagagactgtataatatcaatgaaagtttgacaatctatttcataaagtaagcaaggactggaagtgaagacagagaaaacatgggtagttcactctacatttcaccacgggaggggtctctgaccataaggcagctctagagaaatcaattcaggtaagggctactgcagcccccagatccaacaaacaaactcccagctctgggcctttagagaccacagggaaaagggcaagagtggattcctgatccttataagcacatgggtaaaagcaaggacccatcactcaatgttcagataaatagtggatctaactttctcctaaatgcaggtcggcaatgccctcaggcaagcaaatgttatttttagctatcactacactgaaaagggaaagaggaagagggaagggaagtgggggtgggggaggaaggaagagagggacagggggtggggagagggagaggcaaaccatctaaaatgtaaattttatgtacttctttgtatgttattgttcaataaaaagtttaccaagggaaaaaagtgaactgttttttcattctcaaagatgacgtgggagctccaaaatgccagcatgggtcctacctatacttggagataatgaaatcatcccctagttttttcttctctgggataaatataccaggttcctagctcctctacttgggtattatttagtcactcatacattttctgctctctcctgaaccttccatgttctgtatactccttaatttacaaagtcaaagctgaactaaggtactttatcaggttaaagtagtatgaaccctcacaaatattcatcaaaatcaagtcaaaccttatgatgaaatactaaaggcactcctgttaacaagttgggaccaagacaaaaatgccagctatcagtgagtctaaagaatatgcagaacgattatgaggtaatataaactggaaagaaaaacacaaaattcttatttatatatgatgtggctgttttatcttgtaagcccttaagaaataacttcaaaaccatgagaaccaagaaaaagagtttataatgaggtaggaaaatagggtctggaggcagggaacctgaggcagggaacctaaggccgattcacgcctacagctaaagccaaaggaaaaccccaactttccatacaaacaaaaggatcgaaggctacaccctttgcaaagccccctccttttccatgtggcccagggaaaaccgatcagacatttgactaggagtgtaactttgtaacttcactttagcctctgattggttgctttccccaatcaatcaggtgtttgcataggaatgtgacctttgtaacttcacttcagcctctgattgcaggccactacttcatttacatagcgtgtacatcaagtaatcaatgggaaacctctggagggtatttaaaccccagaaagttttgtaacaggtcccttgagcccctatgctcagcctgcttccaccctgtggagtgtactttcgttttcaataaatctctgcttttgttgtttcattctttccttgctttgtttgtacattttgttcaattctttccttgctttgtacattttgttcaattctttgttcaaaacaccaagaacctggacaccctctaccggtaacaataagatggccagtaaaaatatatatttatacaaacatcaataactttgtgaaaagaaacctcaagctttcttcacatatgcacctgctatggttcatgtcataaataccaagtgaataccaactggctgcaactgcatacttaagagactggtgccaaaggagggcccatccactcacacagaccagacatgagaagtcaaccttccagaggacagttcagccccacactggaaccgaccccaacagaaaaacaaaaaacaaaaaacaccattaacgcacccagaattgtgctaatatgtccaacataatattcatcttgaatttccactacaccaaatccaatcatttctcaaatttctccctttcattgtatggtttgtccctccgaggagctggtcacctcactcaacaaccaacatgagaagatatacaggacagtcattaatgaaactaaagaatcaactctttttcaactataaagtgaagccaaaataaaaaaaatccttttctaaagatgctatgccataaaatcccataattctatgactcattccctaaaactacataccatgaaaaaaaactttgggaaatgaattattttgaagaaacagtaatatcatctctatttactgagttatttattctctagatgaaaaagaaagcttcttttaatatagaggaaaaattaattctttttttttcttcaagcaaaatttactaaaaaggaaaagctgcacagaagtcaggaaaatgattcaggaaatgtttttgcaggaagacacaaacatctttaccaaaacatgttaggtacttgaagaaattctctgtacatgaagaaaattagccctgtaataataattaccaaaataatatacagcatcaatatttgaatttgtaaacagaataagtaaaagtaagaaatacgttgtctttaagctcatccccactatatatgtagcgaatcaatcccttgaggcctttactgttaagttttaccactggcacaggccacctgaaacttcaaacacaggccaggcgtggtggctcacatgtgtaatccaggtactttgggaggccaaggcgggcagatcacctgaggtcaggagttcgagaccagcctggccaacatggtgaaaccctgcctctactaaaatacaaaaattagctgggcgtggtggcatgcacctgtagtcccaggctgaggcacaagaatcacttgaacccaggaggcagaggttgcagtgagctgagatcgcaccactgcactccagcctgggcgacagagcaagactctgtctccccccagcaaaaaaagaaacttcaaacacagactcaaacacacaagatgagtacacctcagtcagcaccagacctgaggacgctccctcatctttttccattttatccctatcaataacatccaactattcaaaccatcagattgttattacaatgttcagattcttgaggatgtagtcatgttctcacccacacagattaacctcttatcagaccaacacaaaagaaggaccatccaaacataaaaacagagaaagagaaaggtggttaacttttttgtgaaaaacatgcctgctcaaattatctacaactcccatctgaactaacatttggtagaataaatacacatgctaaagtaaaaacagaatgagggacagaaaaggaaggaaagagaattatttaagaatttgttaaaatataagatacattacttcaacaacaacaaaaaatcactaagcaaagagacagcagaaataaacttagaacgagagagtctctatagtatctcctggcttggttctacagagacttgtggccgctatttatcatgatttggagaatttgaaaaattgtttctttggtattggataccagctatttggctttctgctccaaaaatagcctgaaaatatatagctaagatttatctgggtggccgctttgtaacaagcagctttaacttcagtgcaaatagagtccaaaggtcagagtggtatcctgtgtgaatctgtgacctcaagctgtctgctacgtttctcttgatttttccatctactctgacctcaaagattctcctatagaatctgggggctatttctgctctaaggtcaagtaaaaagattcaaaaaaaggttatacattaagaaggactttccaaagggaaagcgctaaacatttgctcctttacgtggacatgtagtgtgtgtgtgtctacacacactacacatatgtgtaaacaaaataaatatatgtgtagcaaacacaataaacaaaacaaatatatgtgtagattattgtatgttgaataaacagattatcttccaaggctagtgggtcagtacacttcagttatttttctagtaatagagacactagacaatccattctctccctctcttggagtacaaattctataatcaactgtctgggttcacatcttagcccttgctagttgttagccacacagccagagcaaatcacttaacctccttaactcaagttttcccatctacaaaacatgacaatcatataaggattaaataaattagtagatgcaaattacaaagtacagtgtctggcacatagaaaacactacatgaggttaaatattgatatttaaacaacagccatcctaggttatagaaaaaatacgtgataacagcagtgagaataaatgacctatatggatttcagtcttcaccatgattcatactcctcaaccaaataaactttagaattttattttcctttattgaaggagcaagccccccacgcccccaatgtagccagaaaccacaaatgcataatgcagaaacacgactctagatcaaaatctgttaccataaaactgtttaaaaataacacattcaaaaacaaatagaggagcacttaatttagcaaactacaacttttaaacattcttatcacaatgatacctcttttacaaggcataatcacataaaaagatatggtgtatagcgaataaatgaatttcctcacagttttttaaaaaagttttttaataaaaaatttccgtgttacttattaacaagatgaaagtttgctcttcttacaatgtagcaatagtgaaataattatttaggtaacaatcaccaaggaatgttaagttcaaaccaattagctgggcgtaggggcaggcgcctataatcccagctactcgggaggctgaggtgggaaaatcacttaaacccaggaggtggaggtcgcagtgagccgagatcgcaccaccacactccactacagcccgggcaacagagtgacaaagtgagactccgtctcaaaaaaaaaaaaaagaaagaaagaaagaaattttctataataaaaaaaaatttcttgctgggtgcagagatgcacacctgtaatcccagctacttggaggctgaggtgggaggatcacttgagcccaggagctggatatcaacctagacaacatagcaaggcccccattagaaagaaaaaaaaaaaatctactttgggaggccaaggcaggtggatcacctgaggtcaggagttcgagaccagcctggctaacatggtgaaaccccatctctactaaaaatataaaaattagctgggtgtggtggcatgtgcctgtgatcccagctactcgggaggctgaggcaggagaatcgctggaacccgggtggcagaggttgcagtgagccaagattgtaccactgcactccagcctgggcaacagaacgagactccatctcaaaaaaaaaaaaaaaaaaaaaaaagtgccaggtgtggtgactcacgcctgtaatcccagcactttgggacgccgaggtgggctgatcacgaggtcaggagttcgagaccagcccgaccaacagtggcgggaaaccccatctctactaaaaatacaaaaattagctgggcgtggtggctcacgcctgtaatcccagctactgaggaggctgaggcaggagaggtgcttgagcccaggaggtagaggttgcagtaagccaagatcacaacactgtactcctgcctgggcgacagagtgagactctgtctcaaaaaaaaaaaaaaaaaatcttaaaaggctaaaagaaacaagagacaggaactcataaccagtcctaagtctggccaccgtccatgaggcatgaaaaactgcagaaggcctacatctgtaaaacacaaaaacatctgatactagtggtctctaaagactatacgtgagatgttttaagcatacctccttgtcagcagaaattctctgcacattcctatggaggtgtgctttccactaagcaatgaaaatctattatcaaagtataaacaagatgtcttgataccaaactgaacttttccaacctccttacccttaggaaaattattcaaagaaactgaccactaaaacatgtttttaaacatgatatatatatttctaagagttcaacagcttgcctctttctacttttcaagcttttccaacactcatatatttttatacaatcaaagaaataatctttagtacaataaaagaaaaaaattgggtttttgttttgttttgctttttaaagtacatttacagcaatctcttctccatttccactattcccaacttaggtcaggctattatcacctcatacttggtatcagtgtagttaaaacattaactgactatatcatagattcataggtcaagtgtatcaccaatttcctttcaaaacttaagaaaacagcagtctactacatgtatagaagatggcactgttcgaatgctataaactactattttgataaaggggttcagcaggcaatacaggcaccaaagctatgcaaagagtgtttatgttttgctctgtaactgtcctttgtatcctttcttgttgggtaaagaaaatagtgaatccaaaatattgtaccttaacaatattttcccaacagctgtctgccaaatatgtcttaccaggctaaactcacctttctgtgactcccttctttgctttacacatctcttgattggctcacccctgtaatcctagcacttagggaggctgaggatggcttgagcccagaagatcaagaccatactgggcaacataaggacgccccatctctaaaaaaaaataaaaaattagagaacccaggtgtagtggtgcatgcctgtggtcccagctacttggaaggctgagacaggaggattacataagcctgggaggtcaaagttgcaatgagacgtgattatgcctgggtgacacagtgaaacccagtctcaaaaaaaaaaaaaaaaaggaaaagacaacaaaaaatacatctattgaacatgttttggccaataatggtaaaaaggagacactataaaaacaacaataaatgatgtcttacctttaggtaagaatgaatatagttttaacatacaattcaaaataagctataaaatgaagtacatttggttgtagtgaaagctaatctgggaaatttatttctctattgatcttattcccctaggaatagggcagattgttcctaaggtaagacagaagagacaacattattgctagcaaagttgaaattaatcagctctgctccctttctgctgttaatattccaagcaaaggtggttacttccttaattaatacagaagtagtagttatatttatccacactgatagatggctttccactgttaaagtccttctactcaaagaacttatcttctaagaacttaaaattggatttgtctaatattcactgttaataattaaggtagaatgcagcagctaacatttactgcattttgtcttaatcatcataatcatcccatgagataggtacggtactattattgttcccattgtatagatgaggacattgaagcacaagacggtcaagtaacttgccaaagataacagatctaataagtagctaagctaggattcaaatccaggcagtctggttgctgagtccacattcttagctgcacatgataggcctgccataatgaaataatatcaccattatcagctgaccacggtggctcacacctgtaatcccagcactctgggatgccgaggtaggcggttcacaaggtcaagagatcgagaccatcctggccaacatggtgaaaccctgtctctactaaaaatacaaaaattagctgggtgtggtggtgcgtgcctatagtcccagctactcaggaggctgaggcaggagaattgcttgaactcagggaggcggaggctgcagtgagccgagatcatgccactgtactccagcctgacgacagagcgagactccatctcaaaaaaaaaaaaaaatcaccattatcaccacttgaagttttcaaggagcaaactgaaaaagtaaatctactagtaccttcttctaaaatccattagtcacattaaatcctgtgaagaaatatttaatgagcatctgctgtatagccagcattgtgctagtagtaaagggaatactggagaagcagaagacagctattccctcaaaaccttattgtcaaggtagggacacaaaacatacatggataactaggagagaaaatgtatgtcttctctgtataaaagcaacttcctcacaaattcatccatggccagccctcacttcttacttgagtgcatttttaagatacatcacagttgactgtggaaacacagagacaatcttcccaaaaactgttggtgggaggggcagtgtgggtttctaaggactaaaaatcattaaataatctcaactcaattcaattacttaaaaaaaaaacctacacctaaaatgtagttaaagaatctacatatccaaatactaacaaaacactacctgcttttaagaaatcagtctcatgagaaagacaaatctgctaacaaatgtcatttgatgcaagagctgatataactaaggaagagtttcggacacggtgagtagaaataaaggagtaggcaattccaaggggaaattcttgataacataaatctttagggtattataaaaggaaacaatatggaaatgtgaaactttataataattgaaaatagtaaagtcatactccaaatcctgtaacaggtgctgaatattctatatgcacaaatatgactccctgcaaaccccaataccaatgtaacagtagtagtctcaacataaatatttaatgtccatctcagtctctattgttctacagtaatgtccaccagtcgatcaaaaactataaggcatatgaaaaagcaaaagcagggaagaacccatatcaaaagacaaaccaaacaagagagccaaactaagaaagatgaccaagatgttgtaagtattggagaggaaatttaaaataacaacaattgatatgttaaaaaatttagtagacaatatgtttgaacagatggcaaacttcaacagaaagatgaaatatgtgacaaagaatcaaatggaaatggtataatttttttaagtcatcagagatttaaaagttcctttgatgggctcataagaacactctacacagtcaaggaagtaatcgaacttgaagataggtcactagaaatcacccaaactgcaacaaaaacggggaaaaagaagtggagggaaacacagaaagaaggctggagagctgtgggatatgatcaatggcatcatatacatgtaactggagtcccagatggcagaaggggatagagggactgacgcagaaacagtatttggcaggggggaaaaaaaggctaagaattctccaaaaataaagtcatcaaatcacagctccaagaagcccagagaaccctacagaataaatataaacaagcacacaaataaatataataaatacaataaagaacacacattgagacacttcacagttaaatagctaaaaatcaaagttaaacagaaaatcttaaatgcagccagagggaggaaaaagacattaccttggaagaagaaaattaaaataaaaaattcaccagactactcatcagattttttgcaatccagaggacaatggagtaattctttaaagtaatgaaggaaaaaaaaaacacacctcacaacgcagaaatatctccccaaaatgaaagcaaaacaaccagttttcagataattaaaagttaagataattcaatgtcggcatacctgcactacaagaaatggtaaacgaagttctttaagtagaaggtatatgacactgaacaaaaatgaggacctacatgaagaagtggatacctccagaaatggcaaaaacagaagtcaatgcgagatctttttttcacatttttaatcattctgaaagataactgcctaaagcaaaaacagtagcagtgtattgtagagattataaaaaatataaaagtaagatgtatgacaatatcatataggatgaagaggaaaaactggaaatatactgtattgttaggatctcatactatatgagaagtagtataatatgggaaggtaggttgtgatgtatcttgtaaatccaaggacaatcactaaatttttataaaaaggtataactaatacatcaataatagagataaaattgaattttaaaaaaccctcaatctaaaagcaggaataaagaggaaaggggaaacaggttagagacaaatagaaatcaactggcaagataacagacttaaattcaaccatattaataattatgttaaatgtaaacagtctatacataccagttaaaaggctgagattatcacaatacccagttatatgtttctataagaaatccattttaaaaacatagataggttacaagtaaaatgatggaaaaagataccaagcacatactaatcaaaagaaagctagagaggttacataaatttacacaaagtagatttgaaataaatattgaaagcaatagagagacatcacataatgatgagttaattcatcgaaaagatataacgatccttaatatgtatgcacctgacatcagagcttaacagcatacgatgtaagaattcacagaattgtaaggagaaatacacatatccataattaacagtggacttaacactccacttctggtaatccatagtgtgtagaaaaaaatttctatctagaagataccaataacactacaaccaactttacctaattaacatttacagaacacctcaccctacaagagcagaatatacattcttttcaagtgaacatggaacgttcaccaatacagcctatattcttggccataaaacaaacctcaacaaatttgaaagaattaaaattatattatccaactacaaaaaaattaaatttgaaattaacagaaagatatcaggaaaatccataaataaaaataaaacacatttctagacaatacatggatcaaaaaggaagtaacaagggaaaccagaaaatacttggaatagaatcaaaatcaaaacaacatgaaaatttacagaatgcaacttaaacagtgcttagacaaaagtttatagcattaaagcttgtattagggaagaagaaagacctcaaatcaattaaacttccacctaagaaactaaaattggagaccaaattaaacccaaaggaagcagaagaaatcataatgaacgaaaatcaatgaaattaagaacagaaaaataagtcgtgaaaaggaaagaaaccaaagcgagttttttataaacctctaagtagaatgatcaagtaaaaaaaggaaaaagacacaatttaccagtattaggactcaaagaggagacatcatgaggtatacattaaaggaaaataatggaatattattagcaaatttctgtatataaatttgaacttagataagttgaataactccacaaaagtgaaagctaccgaagctcactcaagaagatatagagtagccaggtgtggtggctcacgcctgtaatcccagcactttgggaggccgaggcaggcggatcacctgaggttgggagttcaagaccagcctgaccaacatggagaaaccgtctttactaaaaatacaaaattagccaggcgtggggagcattcctgtaatcccagctactcgggaggctgaggcaggagaattgcttgaacctggttgcagtgagccaagaggttgcagtgagccaagatcgcaccattgcactccagccttggcaacaagagtgaaactccgtctcaccaaaaaaaaaaaaaaaaaaaagaaacagagaatttgaacagtcctttacctatgaaagatggtaaatttacagttaaacgccttccaacaaagagaactccaggcgcagatgacttcgctggtgaattttactgtatttaaggaagaaataatatcaattttacataaactcttccagaaaagagaaaaggaggggacacttcccacctcatttcatgaggccagcattaccttgacatcaaacgcagcaaatacaagaaaccatcaaccaaagacaaagatcaaaacaagtgacattaaactccttaacaaagtaccagcaaattgaatcctgcaatatataaaaaagataatgagagacaggactagctggatttcctaggccgactaagaattcctaagcctagctgggaaggggactgcacccacctttaaacacggggcttataactcagctcacacctgaccaatcaggtagtaaagagggctcactaaaatacaaattaggctaaaagcaggaggtaaagaaatagtcaaatcatatatcgcctgagagcacaggaggagggacaatgactgggatataaacccaggcatttgagcaggtagtggcaaccccctttgggtcccctcccattgtatgggagctctgttttcactcttattaaatcttgcaactgcacactcttctggtccgtgtttgttccggctcaagctgagctttcgctccctgtcaactactgctgaacgccgtcacaagacccgccgttgactttcacccctccggatccggcagggtgtccgctgtgcttctgatccagcgaggtgcccattgccactcctgatcgggctagaggctcaccattgttcctgcacagctaagtgcctggattcatcctaatcgagctgaatgctagtctctgggttccacggttctcttccgtgacccatggcttctaacagagctatagaactcactgcgtgggccaaggttccattccttagaatctgtgaggccaagaaccccaggtcagagaacaaaaggcttgctgccatcttgggagcggcccaccaccatcttgggagctctaagaacaaagacctgctggtaacaataatacatcaagatcaagtgagatttatcctaggaatgcaagagtgagtcaatcctcaaaaacatcagtcaatataattcaccgtatcaacagaccaaaggaaaaaccccatggtcatcgtgatacacaaaaagcatgtaacaaaattcaaaatccatttatgataaaaactctcagcaaatttggaacaaaaggtaacttcctcaacttgataaaaggcattgacaaaaaacgtatagttaatgtgaatgaattattttcccttaaattcaggaacaacacaaagacatctaatttcatcacactgactcaatatcatgtgaggaggaggaatcctagccagtgcaataagacaagaaaaaggaacagaagccataaagagtaaacaggaagaaataaaatggttatttgcacttgacataactaatcataacatagaaaattccaaagaatctataaaaagagcttctagaactataatttaataaggtcataggctataagattgacatataaaaatcaattacatttcaacatactatcaagaaacaattgcaaattaacattttttaaagtaccatttaaaatagtgtccaaaaaacatacttagagaaatacttagagacaactctaattaagcatagccttgtaattgttataaactaactttaaattggccaatctcttctgttacagaaatactatctgatagcctaagtagcctaaaccttccaaatgagctgacttattttattcttctctttggagttgataagagaataagtcagcttattcaggattttggaataattagcaagcctttcagatgaatcagctttcctttcagtagagggtctcttctctcatgcttttcattgacaaaggttcatcccaagagttcacaccataaggttagtatcttggaactaggaaacaaaaaaatggtatgcagcctcagaaaattaaaagcttgcaaaagtaaagttctctctggtaagtggggaactgatcacactgaaaactgacaagctttaatactcacttcccaaagtaagtcataatgacactaacgtgtacaaaggatagcctcctattaataacgcagtgacacatctaactgaccagagttggactgcctaacccaagagcagtcaatgcctgaacaggccagcaactgatgacatttctgtagtgaaaaacaaaccaaaaaaaacccaaaaaaaccctgctgggcaaaatagactctctcaaatttgaaatggaatgtaccaaaagaataaagcattaagcaataggagtaaacgctgagaagtcatgaaattcagagaccctggaggagccatgagggagggaccttgggcatggaaaaagtaagagggagcatagtgtataagcaagcagaagctataaagtagaggcaggtagcagcaggtaggatgaggaagccagtaggtgggaaaagaagggtgaggctgacccatagggagtggtgtaaatggcaaaatcctagagagactatccaagaaaacctgcttatgaaagcccctggagttgtcctggatccagcaggataaatgtgttagtcatcatctattgccacaataacgctgaacaacagaccacaaaatctcagtgtcatacaacaataagaattttattttcactcaggcatctgagttgcgctggcactgctttaagttcaggtcggctcaggtggctctgctgtatggtctcacaatgagaaacaggctgaagaggctgtggcaattcagggtttttcttctcatagtcatgacagaggcactagaggataagcccatcagcccaagcatactactaacctctgcttttgtcttgtccactaacatcccactgggccaaggtaagtcatatacccatgcccaaaatgaagaggcaggtacaaaaacccatctcacatgaggttatggcagggtaaagacgtagaaaactactacaggagagtgaggaattgagaccaatgattcagtctcctacactactccacaccacttctctaagctagttaggcctaaatctttgtaccctgcaaactaaaagagtctaactaaacagagagagcaagaaaattttctaggaccaaagacatgctactctagctcccactctctaatgcaatgtcatctaaggaccctgatctcccctttctccccttataggatatggtctaaaattattttgttgaaatatttctaatcaaaaggtgattggggggattcttaagaaagccaggaaaagagacacaacaaaaaaagagaattttagaccaatatccctgatgaacatcgatgcaaaaatcctcaataaaatactggcaaaccgaatccagcagcacatcaaaaagcttatccaccatgatcaagtgggcttcatccctgggatgcaaggctggttcaacatacgcaaatcaataaacgtaatctggcatataaacagaaccaaagacaaaaaccacatgattatctcaatagatgcagaaaaggtcttcgacaaaattcaacagcccttcatgctaaaaactctcaacaaattaggtattgatgggacatatctcaaaatactaagagctatttatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaagaaataaagggtattcaattaggaaaagaggaagtcaaaccgtccctgtttgcagatgacgtgattgtatatttagaaaaccccatcatctcagtccaaaatctccttaagctgataagcaacttcagcaaagtcgcaggatagaaaatcaatgtgcaaaaatcacaagcattcttatacaccaataacaggcaaacagagagccaaattatgagtgaactcccattcacaattgattcaaacagaataaaatacctaggaatccaacttacaaggaatgtgaagtacctcttcaaggagaactacaaatcactgctcaacgaaataaaagaggacacaaacaaatggaagaacattccatgctcatggataggaagaatcaatatcgtgaaaatggccatactgcccaaggtaatttatagcttcaatgccatccccatcaagctatcactttcttcacagaattggaaaaaactactttaaagttcatatggaaccaaaaaagagtccgcattgccaagtcaatcctaagccaaaagaacaaagctggaggcatcacgctacctgacttcaaactatactacaaggctacagtaaccaaaacagcatggtacgggtacaaaacagagatatagaccaatggaacagaacagagccctcagaagtaataccacacatctacaaccatctgatgtttgacaaacctgacaaaaacaagaaatggggaaaggattccctatttaataaatggtgctgggaaaactggctagccatatgtagaaagctgaagttcgatcccttctttacaccttatacaaatacgaattcaagatggattaaagacttacatgttagacctaaaaccataaaaacgctagaagaaaacctaggcaataccatgcaggacacaggcatgggcaagaacttcatgtctaaaacaccaaaagcaatggcaacaaaagccaaaattgacaaatgggaagtaattaaactaaagagcttctgcacagcaaaagaaactaccatcagagtgaacaggcacccacagaatgggagaaaatttttacaatctactcatctgacaaagggctaatatccagaatctacaaagaactctaacaaatttacaagaaaaaaacaaccccatcaacaagtgggcaaaggatatgaacagacatttctcaaaagaagacatttatgcagccaaaagactcatgaaaaaatgctcatcatcactggccatcagagaaatgcaaatcaaaaccacaatgagataccatctcacaccagttagaatggcgatcattaaaaagacaggaaataacaggtgctggagaggatgtggagaaataggaacacttttacactgttggtgggactgtaaactggttcaaccattgcggaagacagtgtggcgattcctcagggatctagaactagaaataccatttgacccacccatcccattactgggtatatacccaaaggattataaatcatgctgctataaagacacatgcacacgtatgtttactgcagcactattcacaatagcaaagatttggaaccaacccaaatgtccaacaatgatagactggattaagaaaatgtggcacatatacaccatggaatactatgcagccataaaaaaatgatgagttcatgtcctttgtagggacatggatgaagctggaaagcatcattctcagcaaactattgcagggacaaaaaaccaaatgctgcatgttctcactcataggtgggaattgaacaatgagaacacttggacacaggaaggggaacatcacacaccggggcctgttgtggggtggggggaggggggagggatagcattaggagatatacctaatgtaaatgacgagttaatgggtacagcacaccaacatggcacatgtatacctatgtaacaaacctgcacaatgtgcacatgtaccctagaacttaaagtataattttacatatatatatatatacacacacacacacacacacacacacacatatatatatacatatatatataaaagaaagccaggagattgggaggccaaggtgggcagatcacttgaggtcgagagttcaagaccagcctggccaacatgaagaaactccgtctctactaaaaaataaaaaaaattagctgggcatggtagcgtgtgcctataataccagctattcgggaggctgaggcaggagaatcacttgaacccgggaggcggaggttgtggtaagccaagattgcaccattgcactccagcctgggcaacaagaatgaaactccaaatcaaaagaaaaaacaaagccagtagacatgtctagaaaatacggctgcaaccattcaaggattttcacagatggaaggtgccgataaaacatacagaccactccactaaggtataaagaatttcaaggctgggcgcagtggctcacgcctgtaatcgcagccctctgggaggccaaggcaggcagatcacaaggtcaggagatcaagaccatcctggctaagacagtgaaaccccgtctctactaaaaatacaaaaaattagccaggtgtggtggcgtgtgcctgtagtcccagctactcaggaggcagaggcaagagaatggcgtgaacccaggaggcagagcttgtagtgagccgagatcgtgccgctgcactccagcctgggcgacagagtgagactctgtatcaaacaaacaaaaaaaaagaatttcaaatcagactcccgtgagtccaatggtcacaggttcccaatatccaaagcttttgagtactatcagcattttcatggtttaaaaaacaaaacaaaacaaaaaaaacttttgtaagtggtattctctacctaatttcttttttttaaaaaaaggacatgaaccacacacacaagaaaagtgggtaaagtcaaatctaagtgtagagtagaatgaaatggcagaaaacaaaatagaaaaacttggaaagttaacacatttaatttgctggagtaataggtaatgtttactgtcttaaacgagagtcttttgagaaagatagttttcctcaaaaataagtaaaatctagatatacttttgaactatgatccatttcaaacaattaatttactcctttttaaaagtattaacaatgacacaatagtagtacttcatttaaagacaacgagtacacatattcatacaaatagaaactggagctaccatgcacactacatttgctgctgttcaaagatttaaaaatgcctgcttctgacctagactatcctggcaaaatctaattagtggtcaagaagtccatgactaagggaaggaacaaaaaggcaatggaacagcactggcattagcagggatgcaacatgagaacacccggggatgccatgacttcccaagattccctgttttacattaggctgggtctaacaccagagggtgtgagctaacataccttagtacaaactctgtgacacataccattataataaatactattacactgaaatcaaagatttccagttctcaggtatctaaaacgtgcccctccaaaactcaatttaagaaataatttaagaagtgactatgtaaaagcacttccttaaaagacttccttaaacaagaaagaaaaaacctatccctccaccctctttgtggcaaaaacaacagaaaaatcaaaatacaatccttctacagaaaacaatttcttgcctccaaggagaagattcaggcattttaaaacagttctttggtatccaaatgttttgataaggagaatgccaacactgtttaactcagcccaatcaaaaaggggggggggggttaaatagtaaaagagggatatggtttgttcatcactagaataaattcagagttataaaagttatgaaattatctcccttgtgatgctcacatggcctttacactttggtttctttacttcttagtctctattttcagcattaatttatgagaacacacaaggagttaagctatactacccaaaggctttctgtatgcacagacccaagccactaagaactcagagatggcactttaaaagcaagcccagcacccacaggggtcccacatgactttggcctacaacactgctacctgctgatattgcagctcttctagcctgtttttctctggtgacaaccccccaaaaacccaactcttaatataataagttttgaaacatgggtgttataagctgcagtgtctgacccccaaattcatatgctgaagccctaaactctatttcctcagcatgtgactgtatttggagatagggtctttaaagaggtaagttaaaaggaggccattactgtgacttctaatccaatatgactggtatccttacaaaaagatgagatgtggacatagataaacacagagaaaagaccatgtgaggatatggcaagaggcagctatctacaagcgaagagaagaaagaaaccgaacctgctgacatcttgatcttggacttccaggcaccagaattgtgagaacgtaatttctattctttaagctatccagtccgtagtattttggtatggccctaacgaactaatgcaatggagaacaaattttgcttaaaaaaaaaaaaaaaatcccatgatcaagaagagatgctacttctaaatctacccttatgggatttttgatggcttaatggaacacctcaattcatctcaattattgaaaaaaacaccacattcataataagcatccctatagtttttatctaacctcataaaggtgttccacagtatcaatagtaaagcactgttggaacctttttacctagctgcagctcacttccactctttgccttctccactatggtattttcaggaccatatgctaaagtggtcacatcccatggctccagcctaagatggaagtcaaacttatatgacaatgttttcctcaaaatttcttcccaaagtgatgtttttggcattcttacaccaatctaaaatcaaagtactggtactgcaggtctctgaagacattgtgctccacttcacacctccacatctgtgcacgagctatcatgccctttgactatctggaaaactcctaataatcttttaagaatcagaagaaactcaccacctctataaagtcttttgaaaaccattttcaccacctaaaagttgacctaccacccattgtgattatttgtgccagaaacaataagttcctcttcaaagcttgcttggtctttcttgctctgtacacaagcccttcctgcttaatctgtaatgaacacttgtttctctgcttaatctataactagcaaatctctgactctgtaaacaacccttcccaactagttggtaatggacagcctctcccttctcgcctaattgaccttattcaatttcaaacactagccaatcgggtcagcttagactgtgtggtccaactccacccaatgggggaaaggacacaggaactgtgttagggataaaaacccctgccctaccctgctcagtgtgttcttgtgatcggacaggtgcaggtagcacccttctgcagaagtaaatgtgtcttgctgagaaactttctaagtgctggtttttctttgtggcactgagcacttgtctctaacaatttgagggatcgtccaggatcccattctcctctggggaagggtctctgatcatctcttgtgaggagatgtgtcccactgccttgttgcagtggcctcaggggtgagggatcgagacccacctggtgtgacgaataaacccagactctcagcaacgcaggaggaaagggcctactgatactgtggcgacccagtaactgtgcacagaccaatgtaagaaaatccatggggcagtgaagtacttccttggtggtcaggacaccctggaagttgaaagtgtgtgaatgagatgcagaattaagtctgaagcaagtgtggagtccagatttgcagttctgtggtcacctcatacagcttaaggtggggcacgcctttcctgtcgggggtttataccaacccaccaatgctaagagggacctaaattcccatgagggaagcggcccaagaaggatgaagggaaggcaaaggagtgcaagaaacctccagtggggtggttgagcctccagagaaagggtgcaagaaatctctagtaagagaggtttagccccacacatgcaggaaactcagggaaacacctaaaacttccaggatgggaaataacccaagcaggacaggaaatataaaggactagacagacaataaaattccctctaatagccctccaggtctcatgttaaaatactgtaagggtaatgaaaggactaaacattagaaaaagcaacaaatgataaaatattgttgttttatttggaccaaagaacccacccttgaaccctcagtttgcttttttttttggccagtttgggtcaaatgaggattggatttgtcaacttctaatagaatatgtcaatgacaaaagtcctgtctcccaggaggaaatagactatgccctgtgctggcggcaggggcctgtcctcctctaccccctaaaagctacaggaaataagccaaaagctacctcccctgaaaacagaatccctacccccaagcagtctaacaccacatgggaccctttagacaaccttcccccacccaccgctctgccccaagctgaacactcagtccctccaccatataaccctgccctgcgggccccgtcaccccacattcctatggagtagtcgcccaaacatgcccctccctcagagaagctccaacgagaaatagaacaatgccacagggacactcacaacttccctttcctctcctaaaaggagtctgccccaaccctttttcccttaagagaagtgccacgtggaggaatgggaattggctttgtaaatgcccccttaactagtttagaggtcagaaacctgaagagggaacttaaaccactattagatgatccttttggggtcacggatcaaattgaccaatttttaggaccacaagtatacacttgggctgagttaatgtccatcttcagtattctcttttcgagggaggaaagaaccatgatccgcagggctgctatgatagtctgggagcacaaacatcctcccggtcaaaatatccctgcagcagaacaaaaatttctggcccaagacccgcaatgggataataacaatgcagcccaccgagaaaacttgaaagaccttagggaaatgatagttaaagggattcaggaatcagtgccttgaacccaaagtatttcccgagcatttaatatacagcagggaaaagatgaagggcccatggagtttttaaacagactcaaggaacagatgagaaaatatgtaggcttagacacagaggatccccttgggcaggggatgtgaaagctccattttgttactaatagttggccagatatcacaaagaaattacaaaaaatagagaactggaaatggaaagatcggcctatagaggaacctttgagggaggcccaaaaagtatatgtaagaagggataaagaaaagcaaaagcaaaaggcaaaaaatcatgctgtccgctctacaacaaagtacccgagggtccaaaacctgtaaagaacttaagcccccactcactaggccatataaagggtatgtaaaagcaaagcaaggaaacttaaaaacagggagagaaagagggcaaaacaaatgtttcaaatgtggaagaataggtcacttcaaaagagaatgtcccaaatgggaaaaagaaaaagaagtcatcccacttacggcctttgaagaagaatagggaggtcagggattctgtttcttttatctcaagtaccaccaagagccccttataaatttagaggtgggacgtaaatccgaactgctccccggaaagacatcagcttatctccttatgaaatgttttatgggttgccttatttaaattccactacggacctcccgacatttgagacaaaggatcagtttcttaaaaactatgtatttggtctgtcttctaccctttcctttctcaggactcaaggcctcctagcgcaaactccaccccttgaattcgcagttcaccaacaccaacctggagatcatgtccttatcagaagttggaaagagggaaagctcgaacccacctgggaaggaccccttatctagtgctcctaacgactgaaacagcagtctgaaccactgagaaggggttgacccaccatacccgggtcaaaaaggcatcgccctctccaaagtcaaggaccatcatcccaggaccaacccccatcagagtaatgttaaagaaaaaagcctaatctgtctatccttttttttttcctcttctctttcccttagctaccccacatctcattattaatataaacgcatcagagtcaccgcaaatcattacttttgatgcttgtcttgttataccctgtggagacttgcgaagtcaaaggcagctctctactttgcccttcttggaaattctcagactgggcagattctattaactggggagttcccttagacttgggatattatttttaaaattctgttaactgggaatcccgtcctctgcaaacagagcgtctctgccatagctggtccaatgttctatggactacgaaaaatcagggttggacctccccaacaagtctctgtgtatccctaaaactatacaattgtttcactaaaggaagcccccccaccaattgccagcaaaactaatgtaatccagtacaaatttccattactatctcaatttcccaaaattcctcccttcattaagtcgtttctagggtatgggagcagaggtcgcaggggcagactctacaggatttttcaaaattagtttcgttgcctcgtcatcccctccgccctctccttcaaaccttctaatcaaactactagtctctccctacaatgcaatggctcccaaagtagccactgtagaagttaaagatttaaaacccaccctagctattgaaacagggtaccaagatgcaaatgcctggctagcacggattaaatattccgtccgcaaactaaacaaaagcgactgttaacgcttgtgcaacgggcaggccagaaacccaaatcatcccctttctacttggatggtcctccgaccaacagggtatgagctgtatggtatctctcttccaaaaccccacagcctggggcaataaggcatgccaaactctcttgctgttattcccggaagttaaaagccctgcgggtcagcccccaagggccatctgtcctccaggtaccaatgtcaatttcacctcgtgtctctcacagcaaggggaaaacttggcattccttggaaatctagcaagatgaagtaagcctaagcctttctaggagctaaccaatcagtctgcccttgttcatccccaagcagatgtatggtggtactgtggtggaccactattgggtactctgccaaataagtggggcaacacttgcgccctaattcaattggccatcccaccctggcatttcgtcgactaagcaaaaaggacaatcacaaaaaaaggagtactccctacgggtcctctgacccttacatttacatagatgccatcggagttccacgaggagtgttaaatgaatttaaagcccaaaatcaaatagctacaggatttcaatctatattgttctcatgggaaactgtaaacaaaagtgtagactggataaattacatttactataatcaacagcagtttgtcaattatactagggatgccattaaaggaatagctgaacaattaggtcctaacagccaaatggcttgggaaaacaggatagccctggacatgatattagccaagaaaggtgggagtctgtgtcatgattggggtccaatgctgtacttttatccctaacaacacagcccccgatggaacaattacaaaagcctgggccttaccaccctagcaaatgaattagccgaaaattctggaatagattaccccttctctggtctcatggaaaaatggtttagaaaatggaagggactcataacctcaatctttaccccccttgcaattgctataggtgtactcattcttgtaggttgctgcaccatacctcgtatttgtggatcagggcaaaggcttataaaaacagcccccaccaaaacccctctcgattctccccctccctactcggataagttcctactcccagacaaccaagaggagcaacaaagccaagatatgttacaaaaatttgaagaggaagaactataaactcaagagggggaaatctgccagacacaataagttcctcttcaaagcttccttcgtctttctctctgtacacagcccttcctgcttaatctgtaatgaacacttgtttctctgcttaatctataactagcaaatctctgactctgtaaacaacccctcccaactagttggtaatagacagcctctcccttcccgcctaattggccttattccattttaaacactagccaattgggtcagcttagactgtgtggtccaactccagccaatggggaaaggacacagaaacaggaactatatagggatttaaaaccctgctctaccctgctcagtgtgctcttgtgatcagacaggtgcaggcagcaccattctgcagaagtaaatgtgccttgctgagaaattttctaagtgctggtttttctttgtggcaccgagcacttgtctgtaacatttgtgtgtctgtctccttcaatacactgaaaagtccttgatggcaggaactgtatttatcttttatctgtaaacccctgtagagtgcctgtaaatgtgtactgaataaatgaatgccaccaacaaatccagacccaaccctcaatggcacaaatcatatgttataatcaatgcctcccaacaatttgaatctcacagatatactttgcactaaagaagccagatacgaaacaggacattttgtattattccatttgaagttcaataacaggcaaaactaatctttgtgacagaagccagaactaagcggagtagggtagagtgaggggggggtcttatccaggaagggtcacaagagaaccttatggagtgttggaacagtctctatgttgatctgagggtggcagttacacaggtatatacatatctaaaagaataatcaagcagtatacttgagattagtaccatttactgaaatttatcttgtatttcaaaaacccaagttctatatatggccctcatctgcctcaacccccatccaaacatcaatgctcaataaacatttgtgactgaacgcctaaatactttctaaataacaacaatcaactacactattttcatataagggaagaaaaatctagtcaagcaattgcagtcaaagttttgggctggagctaagctaaccaccaccatcacctcacacaaacaagaaacttgcttctgtccagagttgcagtgtgcctacaggtgctgcatgggtagcatttgcccctccctatgactggctggaaacatacccagccccactgttgaggcataggatcccaatggcatttcaagtcactaggagaaaaaagtggaattttacaactgaaggctctatcacatcaaaaatctagacacactggcaataaaatcagaagaaaacctctgcccacctttccaggaattttcacttaatctttctgtgactgttacctgcctgacaaactcctattcatccttcaaatcccaactcagatgttaactcttctgggaagttcttcctaacctcctcaccctccttctatgttccttttactgttctattactttggttcacttcaatttaaatattggtcatgtttatttcccctgagatcacatttgccattctagcacgaagtacatggcagggctctttagaagcatgaaaatgtctgttgaagtgacttgaaacacgactactactggacatgccttacaatttatatgcccaactctagagtcccaaaataagtggtatttcctagataaggcacagtctgtacttatgaagagggagtgaaaaaactataaatattctctaggacagtgttatttttagtattatggtcaccagcctctaagagtgaacttcaaggtagcaacctggagactaaatgactcaaagattatgggatctgccaggaaaggtatgctcctgaagctatggtatagcagatatggtcccagaagcagtgggttcactcgcttcaaggcaggatcttcaatgccctgcatttatataaatgtcagaacaagtaactgtgcaaccccaaacaagttactttacctccctgtgcctcagtttcctcattggtaaaatgaaggtaataacagaacccaaaatttcatgtggtgttaaaggattaaatgagatgatacagtgcctggcatatcgtgagcactcaataaatgtttgctccaattatttcactgctctgggacgggacagggatccctcagttttatttggtcctgtcatattcctgccctacctggcaccggcaccaaatctcttctctgagcctctccaccctggcttccttgcttgcacagctgattaccctcaccacacagggcctccctctggccatgaacacaacccaacaaagcaaagctacactgcattctttagtccctctcctcttccactttcctaatgaaaacttagttgtttcctatttcatttccgtggtgctctatctccttttggttagcagattaatgagagcaaactgatcaaatacccatgtccctacagtcactctctcaaagattctcatgaataaactcagttaaatagagtaacatgaattacaagaatttcaggctctactgtctaatgagacaaagcttcctttccgctaccccctcctctccctctctctttcttcctggcaaagagaagaggggatgctggcaccacaaaccacaaaaagaaggtgcccatttcaccttcctatgaggcaagccccttggttgaccaccagagcagttttacctgtgggcttaccccagccttcatctcacaccaaggagtaaaactgccagtttgctcaagtttaagggtgtttaacgaaacacagtccagtgactgcagtgagcacagtggttcaaggctgggtgctggcctgcctttcttgcctccctggtggacagtctctaatccaactgtgcctctgcactgctcctcgcactgtcatgcttttacaagtcagtggggtcatcaccagcatttctttttacattaaaaaaacccagaattttaaaaggacaattttatagcatgtaaattatatttcagtaaaactttttttggagacagggtctcattctgttgctcaagctgaattgcagtggcatgatcatgggcaatcctcctacctttgcctcctgagtagcaggatctacaggtgcacaccaccacaccgggctaatttttaaaatattttgtagagatagggtctcaatatgctgaccaggctggtctcgaactcctgggctcacgtgatctgcctgcctcatcccctcaaagtgctaggattacaggcatgagccaccgtgcctggccaaaactatttttaaaagattagagaatagaaaatcgagtgcatcacaagtggtgagagtaaatactgaatattaaaatatttgaattatgctgggcatggtggctcatgcctgtaaacccagcactttgagaggccaaggtgggtggatcacttgaggtcaggagtttgagtccagcctggccaacatggtgaaaccctgtctctactaaaaatacaaaaattagctgggtgagtggcaggtgccagcagtcccagctccgtgggaggctgaggctttgaacctgggaggcggaggttgcagtgagccaagatcatgccactgtactccagcctgggcaacagagtgagactccatctcagaaaagaaaagaaaaaaacctttgaattaacaatgcaaacatatacacgtgtgtgtactaggcacaatatagtgtttttatcactatgagttatggttgcaagattacaaaactctagtttcagcagtcaggagctggcctaaggtaaattccttgtgtaaggagagctagcaaaccctttggaatgcttcatttcaaggcattaaggttgagaaacattgaatttaaaaaattcattttgggctgggcacggtggctcacgcctgtaatcccagcactttgggaggccaaggcaggtggattgcctgagctcaggagttggagaccagcttgggcaacatggtgaaaccctgtctctactaaaatacaaaaaaattagctaggcttggcggtgtgcacctgtaatcccagctacttgagaggctgaggcaggagaatcacttgaacccaggggaagcagaggctgcagtgagccgaaatcgtgccactgcactccagcctgggcaaaagagcaagactcagtcccaaaacaaaacaaaacaaaaaagaattcatttcatgaagcctaactcccaagattctacatccagctggaaatgacagggttagcaaggccttaccctgggttcacctattcctgtgtgcatgtgtgcgcatgcgtgtttgtataggaagggtgggggtgggtaggtagggggtgtcagggagaacaggggctgctaaagaatgtgatcctcatgttcctaggcccctggttgaatatcatctcattctccatcccatgcttaacaatccaacgagtgcccaggtttacacaaaaagatgctgagttcagttttgcacttggacaggcaggtggagctgctgagtgtatggctggaaataaaggtttggatcacaggagagggttgggatggaaaaatagattctagagtcatcaaaagttgaaacaacaagaaagaatagcatgcccaggaaggagtataaaactagaaggacataagaccaataagatatgactgaggaatagttaaagattagaggagtccttaatagttttttaaaaattaaaaccccaggaactacataatgactggtcatgaaaatcagtggtcctcaaggaatagcagaagattcctaactcttcaggttgcagatgtcttagagttggctatgaaaatcatttcctagtctcattaatactatcacaatttcttaactaagcatgtgggtgactcaaatggccttaatcctaaaacggaaaataactgtccagataaagcctctccaagtctcaggaagatttgaacaaacacgtctgcactggatgtgaggttccactttagaactctgccacccatcttctctaagaagaccaattccccacctgtggcggggagcacagaaagaggtaagcagggaagaaggctcaggaagctgggccacaccattttccaagggttttcatttccatttctggaatcctcggactaccaggtcaaactaattgatactgaaaggtatgggcacatgactacgtaatacaatgcaggatccttgactggatcctaatgggggacagggagttgggggtggggaggctacaaataacattttcatgggaaaattttaaaaaggactgcatattgggttttacatcaagtttcctgagtgatataattacactgtgattattctatgtaggagaatgcctttttccttaggataaatatgtaaagtatttatgggtgaagcattactgtgtctgtaagtaactctcaaatggtattgtcacaaaaaaagtcatatatagagagacagaaagttataaagcaaatttgtcaaaatgttaataacaggtggttctaggtgaaggggggatgggtgttcatggtattgttctcatacctgtctgtaggtttgatacttttcaagatagaaaggactataaatcctttaagtataaaaaatgtttttaatttctacaggttccaactcccttccattagaatggagaacaaagagttgactcaaaaatgcctcaaaacattctttaatactattcccattcacaaataaaggaatttatttgccaaagagaaactgaatttcaagtgcacaaaccaagtcagcctctatcccacactgagttcctgagttattatataaattaacacaagttagatgttatttttaacataaaccttccatatgttgttggatactttacctgaattctttattttaaagggtgtattagtactaaggagttttacacaaataccaagggttaatggcaaatttacttatttatagctaatacagagagacagcatggataaaccacatgtaagacttattgtgtaagacttattgttttaactagtaaattttaattttaatcagaactattagtaaaattgacaaaatttcatctctatctactttcattcctaaagaagattctatttaataacaaaaaggaaagaagtgaaatgaaaatatccaaagtactcaagtatgaatacttgaccaaatgaaaactgactttaatgcaggcaaacagtttttgagaacctactatgtacaaacctctatgaggaattcaaggtacaaagaatgggccatgcacccatgaggaccacaattttgtaggaaaagacaaacatttagaacactgaaggaaaagaataatggttgactctgtctcaccttgtcccagctgctaatgcctcaattcaaagacttatctcggccgggcgtagtggcttatgcctgtaatcccagcacttcgggaggctgaggcaggcgaatcacgaggtcaggagtttgagaccagcctggccaatatggtgaaaccccgtctctactaaaaatacaaaaaactggccaggtgtggtagctcacgtctgtaatcccagcactttgggaggccaaggcgggcagatcacgaggtcaggagatcaagaccaccctggctaacacggtgaaaccccgtctctactaaaaaacaaaaacaaaattagccaggcgtggtggcgggtgcctgtagttccagctactcaggaggctgaggcgggagaatggcgtgaacccaggaggtggagtttgcagtgagccgagatcgtgccactgcactccagcctgggcgacggagcgagactctgtctcaaaaaaacaaaattagctgggtgtggtggcaggcgcctgtaatctcagctactcaggaggctgaggcaggagaatcacttgaatccaggaggtggaggtcacagtgagcagagatcgcaccactgcacttcagcctgggcaacagagcaagactccatctcaaaaaaaaaaaaaaacttatctcctagtcagtccactgcaatagcctctgaattccttactccatcagacccctctaaaagagtagttctcaaactcagatacgcactggaatcacctgggaaattatcaaaaatccaatatctgggcctctccttcagaaaatctgattttactgtttgtagcctgggtactggtatttttataagctcttcagatgattctaatacacaacaaagtttgagcaccactcaaccaacctctgctgctggagtatagagtacaaaccactttcctgcattaaaacctctgatgactcctcacagccaacacaaacccaaacaactcaccacgatctttaaagcctttctcaacatctccaacctatccctcctccagcccctcacctaccagtactccatggctctccaccatactccagccagaatgaacttatcatttgcctctgagcccccagcaacacatttcttatgcataaaaggctctccaaactcacaaacactaatctcagtctctgattatcaaactccaaatcaattttcaagtacccatttaaaaggtcttcctttcaaaagccttaacctactcccctggcttaacggttgatccttcttcttgagtcttaacaaaatttggacatagctctaatctgacattgatcatgatgcttgtagtggcagtttacctttctgtctcttctaacacaaagtgcattccacaaagggagagatcatgtgcattcccagggcacgtgaatgactgaaacacaatgaattttcaataactgtttgctaaataaatgggcatcacacacttgtggaataaatgaataatataagaaaagacaaaggcaattcaatatgaaatgcccaattagttacagagggaaaatctaacccaagaagtgctgtggggagagagattgcttcaagctgatatggaaagagaaggctccatgaagacacgggtcttgctctcaagtctcatggaaggaaaatatctggatgggccaagagggaggggcagaaaacaataagcatgggaaacagtacaaaagtagaccattccacaggaaaaaaaaaaaaaaaacacctcattaaaaaagctcagtgctttaaagcaaaggtttacttgcttacactatgtaatcattacatatttctttaaaaagaaaaggtatctgcctagaagggacacacatcacttccactgaaatgtcaatatccaaagcaagttacacagccatgcccaatttcaaggtgtgagagagaatgtaaccctactatgtgtccttaaggaagagaaccagaatactggagtcctaatgaccacacgatgaaagagtctagcaccatacctggcacatagtaagcactcagtgattgacagctattattatcatgattactgagggatctggggaaaaaatctatcctaataaccctaagtcatataagcacatgtgaaaaacatcttatgcacattatttaaaataaagcaaaggttaatttacaagcattttaccgtgataaaagggagggatatgccaaaaagtttccattaagcaaaaaaatagtaaacaagatttaccaaaatagtacaacaagcattttaccgcgatatgagagagggatgtgccaaaacgtttctagtaaagaagagctattaaaatacccattcttactaatttaagacatgtaatatttcactgatagtatctttattattttagagaacattaagaaaattatggagcctttcacatgttcactcctaatctcagagcacagctatcccatatttcccccatgaatttttaagggaaattctcctacgtgggttttcaggaccctaatccttggaggttaagggaaaagtcctatacagcaaaatgaaaattgaattctaatcaaggcttgaccacagatcagctctgtgacctcacaaatatttacatgactaggaccccatcccattatgaataatgaaaatggatagatgtcttcagaagtaccttctaactctactcttctgcaatcccgacaagatagaaagtagctttggtttcagagaatctagtaatgatggtgacctgtgtaagacccgataacacttaaatctgccacaaccacactcataagggcaacaacaaaacttagttcaagagtaaatatgcaacacagtcaagaacacacagggagagctctgctacatgaaatgctgcagacacaaagtgcagataaaaatggacagagtgtggttattttgtgtgtagcttatgaaatcacaatattttagtaacatctcatacagcattccaaggacaagtggcagtgatgagaacaaacctgaagtaaggaacctccaaaccttttaagcttaggatctgtccaactatcagatctaaatttcagcacactgggctttccacttctttaaaaccctacagcaagaattcaaatacatgcccagagagctgggtgcagtggcatgtctgtagtcccagctactcaggaggctgaggcaggaggatcatttgagcccatgagtctagcctgggcaacgtaagagacccagtttctataaaacaaaaacaaaaacaaaatacatgcccagagatctagaacttgacatccttagaagaaagtcagacaaaaaagccaaagcagcaagttacaaaatgttgtgccccataatcagtgacacttgtgtcaaacagaagcacctgcccagacaacctaccgccactcactgctttgtgagtatacaaccacccttacaacagaattaatgagaaaacagtgctgatctgtaatgaacaccaaggagagactatatagcattaactcatgccataaacaaaacagacactgctgcattataaattttgctacactggcagccctatccgtgatttttaaggaaccttccaattttaatgttctgtgagtctataaaccacataggacacccgttactgtctctcatgcttcaagagtcactgcctaaatgactaacaatttcctgcttgaaaatctaaaacctggtaaatatatctaataaaactgctgtatgattagactcactttgttacgactggacagtatttttaaagctacaactctgcatgtggatctgtgtttcctttttttttcttttttctttttttttttttttttttgagatggagtctcactctgccaccaaggctggagggcagtggcacgaccttggctcgctgcaacctccgcctcccgggtttaagcgagtctcctgcctcagcctcccaagtagctgggattacaggcatctgccaccatgcttggctaatttttgtatttttagtagagtcaggatttcaccatgttggccaggctggtctcgaactcctgacatcaagtgatctgcccacctcacctcccaaagtgttgggattacaggcataagccattggtgcccggcctatgtttatttctacagtaatttcctccttcttgtcaatcacaacataattttcaattttgcaatagattttgatgaatatactacaatcaatcttatcattgatttttaggagtttaaaatttgtattccccatttacaagtagatggggagaggagacggagaatatgcaaccccgaatgaaccaaagaaattgcttctattaacaaatcaatttttaaacatattggaaagggaggagaggataagactcagtctttcaagggaggcttggtaaatgttattttaaaaaaacaagattcccttcataaagttaattgataggccgggtgcggtagctcacgcccgtaatcccagcactttgagaggccgaggcgggcggaatacaaggtcaggagatcgagaccatcctggctaacatggtgaaaccccgtctctactaaaaatacaaaaaattagccgggtgtggttgcaggcacctgtagtcccagctactccggaggctgaggcagaatggcctgaacccaggaggcggagcttgcagtgagctgagatcgcgccactgcactccagcctgggtgacagagtgagactccgtctcaaaaaataaataaataaataaataaataaataaataaataaagttaattgatagataaacctgaaatactttgtatggtaaaaatatccattactggtctaaagtaatgggaaaccctatagtcagtagtttgtattgagaacaggagaactacagtgttatacttaaaagctgcctatcttcaatcttagtatgaaagaaaaaagcttcaaaagtcatgttgaaagacatcatgcatgttagtaatagacaggaagggtcataagtccccgctggaacagctgccttgctttttgtaaagccttacaagacacatctaaatttattctctgatcttactattttctgaacattcaaatcaactttcagataaaaataaagaggcaaatataaatagataaataactatcaatttttattatacggcttgcttagactcattttaggttaaaggacaatcttgtttcctattatattttccttcacagacacagaaaaaaatccacctttgctccaaaaagggtagaaatgctaaagggtctagagctgtgctgtctaatactggtacgactggccatgtatggctatttaaattgaagctaatattaaataaaatttaaaattctcatcctcggtcatactagccacatcttaagggcttgaaaaccatcagtggctagtagttcccgtgcagatattggacacctccatcataacaggaggttctactgaacagtgctgatctagaacaatgtttctcaaattttgatgtgcacaaaatcatcagcatagcttgttaaaacacagactcctgggaaccctaggtggtctatttcagtaggtctggaatggggcccaaaaacttgcatttctttttttttttaagacagagtctcactctgtcacccaggctggagtgcgatggcgtgatctcagttcactggatctcagttcactgcaacctccgcctccccggttcaagcgattctcctgcctcagcctctggtgtagctgggattacaagcacatgccgccatgcttggctaatttttgtatttttagtagagacagggtttcacaatgctggccaagctggtcttgaattcctgacctcaggtgatcgacctgcctcggcctcccaaagtgctgggattacaggtgtgagccaccgcacctggcaaaacttgcatttctaacatgctccaaagtaatgctgaagtttcccaacactttgattagtgaagaagtagtttttggttttgctctttcccaatctatggccaagactttcataaaacaccagaaaaatgaatttccaggaaaaaataaacaaaaaaggactacaattataaactgtttttataattagattcaacaaaccatttttctaaccatctgctataaaagcatctacatgcttcttttcaagttctgtactcaccttgtcagacaggtaagcagaccacagatctgcaggaatctgtagactactttcagtagcctgattcacaagagcttatttttttacatttttacacttatctttctggagctggtcattaatgacctctttcatatcctctatcatttcctcaatgcatttttacaactcaaggcaaaactgttaattccattaagcaaaatacccctaaatcccttaagtgatattataccaggtttgcttaaagaagcaatctaatggtgtcatcacttacaatgtgatctgattctatcacaggatcaacaataatgatggcttaactttttcatgcaagcccatagttgaatttagactgccagcagtgcaagaatttctaagccaaaatacacaatgagctataataaagtctctgtgttaaattatgtaaaattctttccgtaaataaaatctatgatctagacttagcttaccagacataatccttcaaagtatttcttagaatactgatagtttttcttggacccaaagtagatagagtccagatatatttctttactcatatacacttaaggaaggaacaaaccaaataatcaagtcaatgcccttcgcaatctgcctaaagcttaggtattttccctaatctaattattattatctattattaaacaaaataaactgatttttcttctattcaacttctggtctggcccaacaaaaaaaatctccagaataactttaagtttgaccacctcctagagttactctcagaattttttcattactctaatattgttttggcaatttgcttgacttattaagtaaataataaggctctgagaactttaatataaaatcctttttatataataacacctggttttatatgtatgttctctgtaaaatttttagcagtctaaaaataagcttttatgttcaactacacattattttaaggaagaactccactaaaaattagcactaatggaagttgcaaagcatttcataaaagtctggggaatataaaaaaatggagggcttcttttaattcttcttcttcaatgtaagaaagaaaaacccttttcctcctaacatattgaatgaagcaatagcagaattagtaagaagcagtattcaaagcaagaaaatgtcaggcacatttgccatggcctcccctctagtcccatctgcagaggcagatgtgtgaaaaagagaggctgaggaccctctaagagcctccatgtctcccactccaacctttaactctatcaggctgcaagggcaagggcaacgaatggcttccatgtgatcatgtgatcacagcgagggaagaatttgggggataaccccagggaatgcctgaatgctgccagagggatgcagttcttccccaagcccaggccaagtgatcaaggctgagactgctaaaggacaaaaaaggtccaaagaagtcagcatccaggcagaagattttgttcatgcaaagcagttgttctagaatgacctaaattaatgatccttagtatgttttgtatgctggtggaaaggtatggcgataggggtatgagaggcacagatccgtttgagaatcataaaaaacaatggattgtccgcctataaaatacgcagatgcaaacaaaaatttgcatactattttggggcgttcacagaccagccaaagactccctaggggtccacgaactgcaggataaaaagcttaaacctttaggtaggaagtaaagatgtctgttactacagtagctggaacttttaacctgaagccaggcttttacataaaaacaatcttagagtataaaaaaaaaaaaaatctaaaaccaaaataccttggtcacatagtatataagaaaatccaaaatatattaaaaatttaactacttgataaagaataacatatttgatccataaaatgcgatcagcgactatcccttataagtatcctcaataaaggggtaaaaaaatggaaatctccctttacttatttagaaaattcaaatatgcatccatcactttctacttatgtttggattcctgtcctggttatcttacaattctacttcccagcatcctgaaattttcaaatactgtcttagtatattaaactcttttgaaatagataacaaaagcaccatgggagtccgttgaaaacttaggtttgttccttgctaaaatttctaagtccttcattatgactataaagaaaaaaggttcatcaattcaaaaaaaaatcctgattcttcaaaataggagctatttaagttacatcatatacaccccattacaaattctaaaggttgcaaaacagaacagtgatggcaaacaacataatgaataaatgtaagaggatgcacagaatcactatttactgactataaaaaccaacaaatacaggtactacaggcaaaaacaaacatttttctttggattttatgcagatgatttagttcagaaacagggacaagcatggatattttaaaataactccattttactaccttcaggacttttatggaagtaacagaatttctcatgagggtatcaacgcctccacaacatgaaccaaagaaaagaacattttggcaaaggaaaaagtgactgcgttctccctctgcacttcatggttattactgtaccagggtacacctgaactcctaagtgccccaggaagaccactcctactccatggagacaaaagtggggaaaagggtgtcctcactgtattccaacactcctcttcagtgacaaattcctgaaacggaaaagtaaaaatggatgcacgtgtagaacttagggaaggtgtgttagctaattaacctaacaccataccactaaaatacaacagtacgcttgagcttttaaaaaaaatctttagagagaactactggtgaaaaggacatgtattggatacagatgatcagggtcaaattctggctctatcactgactagctttatggcctttaataaattacttcatttctctgagctgcagcccagtctcacgaagtggctatgaaaacaaagatatttttcccaactctgtagccccagtatctggctgagtactggacaaacaccaggtattcaatcaatgctagttctttttgctccactcacaagcatgtcacattccattgcaaaaaaaaaaaaaaaagttctctagggaagaggtatctcagctctggctatcattttatgtatttcaaagagttttcaatataataacctggtacaggagaatgcaggcaatcctatggaattcactccacctttcacttgaattaaactaaagctctgcatgagcaatgaagtataagagaatcattaaatatgtattaaaaacaaaactatttcaagccttcttataccaggcggggaaaggggaaggagggaagtagagtgcagcctcctcagttgatatgtatatactgtcattgtcctataccaaagatatttctgcaggtagaatctttgaatccttaaacttgttcaaagagattcagaacatgggtggtccatgagtgatctcatttagtaattaccaattaaagtctttccatgaaaaacataggcacctacagggagaatcaagcctgatgttgtggaacctcatggtataacacaggaagacataaccacaaacgctgcttcgggcaaagccatacttccaagaaaaccaaaacatttcttcaaaacttttataaaccaaggagctctccaacacatagtagcccaagggccgcctgttgtttctgataggttttctgcaatttcacagcaaaatcacaaataagatgtggcttctaatgagatatgattctgcttcaggttttctttggtatttgaaatatacaaaaagtaaatcaataaatacaaaaacataactgccaaaggttcttccagaaatgcagcagttagtcgtatttctcccacttcacttctaacttgtctttcaatttttgtgtggtttgccttaactaatacactgatgagttcagagaacttccccaactacatgaataataaattataaaaattataaagatatagaatatttaaaagttgtaaaaatgatcatattgaaagagtttgcagtgctattaaatgtaacagaagagctaaatgtgaaaagcaaagaaatagctgcagaataaaaaacgtgactccaggaagactgtgataccacactgaagcacaactcaatttcgcaacagatctagatttacttcgcccatggccagactacaccaagaacagtactatggtctggttactattagagagactccaaagcaaacaaaacggtggggaaagatgtgtgcaggatagcttttagtcacccactaatcaagaaaaatgtttaaattcaaaagaacttataattcatctatgaaatctgccctggaacaaaaataactccaaaattaataatcttaccactccgcattttcccaaggcctttggttataaagatgcattgcttatatgaaaccacctgctctgcttggcataaatcatgttacttgaggattcatgcctaatcattttatcaaacacagatctcaaatcttctttctgttgccagagagccataaagttcacaaaaactctctctctgaggttgccaacctgattttccaatttggctgacagtcaaactcgactgtgccatgaaatcaatgggacagacccccaataagttacacagctcacatcagcctagggagcaaaaccgagtggtctgccccggtgttttttccccaaacgccacaaacatatttccacaaagtacatcaaaattgggggcccattgggatggtactcttacataccatctgggaaacaataatcaaatttcaggcaatatttcagacatcctgaaaactgtaaatatttaaaatgtgtattttctgtgttcgtggatctgccagcagaaacgaggagttttcagggggtgggaaataaggcacacacacagccccagagagatgctcagagatgccaaggattcaccagaaaccttggccagattactaatggtccataaaccctaatttggagaacagggtcctacgagctcaaaattgaattatactgccttattagatcccacacgactgaaaccacagtcacattagtcataactggaactaggaatactttatgtacacaaatataaagtgcctgcttatgcatttttaattgtatcaaataaaactgaagctgcaaacaaactcaaatttcaattatctcactagtgaggggatttcctaataacgcctttaaaaaaaaccaagtagctgccaaccctctgcacatccgataggcatgtccctggaaatctgggcgcaacggactccgttacttctcaacagcgaggaaaataaataccttgaagaggacagatagatctttttttaaagctccaacatgcgatctaataatgcacaaaacttggcagcggggttgcaggacccctcctgggctccaattttcggggcgagtgcgcgctagtgcgtaagaagggggcggagggggtgcgcgatccgaggccgcgcaggggcccccgccccctcccggaacagcagcctggcaccagcccaccctcctccacccctgcaaacagacgcaggacgcgaatagagcaacttctccgcgggggcggcggcgggaatagcggtcacccccgccccgccccagcgcggctgggcccgggggtcccaccgcgcccgccccggggggggcctcggcacgccccgcccccgcccgccaggcccgcggccggggtctgcccggacccccgcccctgcgcgcggcccgcagcggcgcactcccaaggacggccgcccggcccgagcgaaagcgggagcgggagcagtagcctggcgtggcagaggccgcccctctccccaggccgcaggccgccgcctgccctccgccaggccgcccgcccgccggccccgctcggaccccagcccggccgggcctggacgccgccgcagcccctcatcccggctccattcataggggcaccctaacccggccggcggggcggggccggggacccgcggacaaggccggtccgccgaggccagggaggaaaataaaaagttaagagaagaacttacctaaaatggctcctgcagcagccaaaatacaaacagctattatttggtgaagtttagctcagacaccctgcaaggacaccctaacccatctcgggcccgccttccctgtcgcgccattgggcttcgccggtccaaaacacagacccattggtcatcccggctgccgctcagacagaagcccatttcaagcttgcttgcaggggcgagtgatgggctcgctccattgtgctcgtatttgcatggatgtgatcgcggccttgattggccggcgctgagaccgccccgccccctgcctcgtgccccccgccttggagacgccgctgcgctcggccccgcccccccgggactagcggcagggccacgggggcggggcggggccggggtcccgcgggccgagggggcggggcggggtcctgcacgctgcagatcgcaggcagggggcggggacctggcgcgctcgggcgccggcgggggttcagcgcccaggtggaggtctctcaggtagctggctagtgatctggaagacccggggctggcgtctccgggggtgggggaggatgtggctggggtcccgcgacacaggggttccgcaggggccgaggccacgcgggcagatgcaaggagaagcgagggacccgcaggtcaggaaaagaagatcctgagtggccaagcgaacggagcagcctccacccgcgtcttctgccgctcagcccggctccctggtactcctggctcccaacgggcttcttcccaaggcccagcgcacccgggagttttccagccccggggaccctgcagcgccttggatagatctccgtgaaatcaggtgtcgagctatggtgcatttattttcgggcctgtcgcccctaccatccttgtagcatcctcaaggacagggcccagtgtttggcagagattcaactaattgttacactctcgaattcattcgttagcaggtaatctttgagtgcccactaaattccagacattgatataaaacgggatattgcggtcaacaagacaaagcccttgctttcatggaataggcgaaagactaaatacaaggggtaggtagtgataaatgctgtaaagaaaatagatggaagaagaagggaaattagaccagggtttaggaattaggaaattcctaaattatgaaaggaggtatggagagtttgccctgcctggctgaatactctgtatggcgtctcattactgccccctcccaccctaaccttggcagtcaccagccctcctcgcgccctgcttgcccatcgtgttttctaagcacccactaaaaaactgattggattctgactgtagaggctcattctacctcaaagcagaaatgatctgagtctgatgattctaagagcagtttgtgggatacatttaggataagcacattttgactgtgtcaggggccatgataatgatttagcagaggcttactaactccagagagagaatatttttagcttctttgaaatcccagttttctgatggctttcagcctgtggccctaactctcttctgagtaacactcttcacttcttggcagacacaagagatttctccagcttgaaaacagaggcagcagccccctgctgcctatctctctcatctgtgtgcatttctgtcatttgactcaaggctggccaagatgtcttatggtctttctttcttgtctttcttcctcccttaaacagatatttattaggcaccaactatgttccaggtattgttctagacacaaggaatgcagcattaaacaagacaaataatatctttgccctcaaggagcttacaatccagttgagggtgagatagagagttacgcatagatcctgaggatctccaattttgccaagctgctggtgagtgagtatactgagggctactcgcctgctgctgcctcttggggacagcatgcttgaccttctgaaccagctgcttcaggagctgaagctgaagctgaggtaggaccaggcagctggtagccacaacctctccagctcaaacaccagaatcacaggttccaaagctctcaacagtgcccatgggagtcttggctctcatgtcttgaaagagtttgggagcagagttgttgttttttttgttttgtttttgagacggagtctcgctctgtcgcccaggctggagtgcagtggtgcgatctcggctcactgcaagctctgccttctcggttcatgccattctcccacctcagcctcccaagtagctgggactacaggcgcccgccaccacgcctggctaattttgttttatttttaatagagacggggtttcaccatgttagccaggatggtctcgatctcctgacctcgtgatccgcccgcctcggcctcccaaagtgctgggattacaggcatgagccaccacgcctggccagggagcagagttttatcagacagttttggtgggtcctatgtgggagtcacatggccctccctttgcataataaagtctcttgcctacaaaaattgaaataacataaatgaggtgggactctagacagagagagcagtatgtatataccaatgcaagaggcagcctggggaggtgtgagagcaagaggaagatggaaggtggacttgtcagtaattgctgttcttaaacattgagaaaagtcagtagcacataagaagttagatatacacagagacacaatattaagtcaccaaaaaagaaatcaatagaagtatatgactgattcacaaataagtgggacaggtacaagcaaaggaatggtctggggactacatttaggagaagtggcaggcttgaccttatccagtgagaatcaggtctgcagaactgagaggagttagtggagtctgacccaaggtacttcaccaggaaccagtggggaggaactgaaggggaaagggaaacagagacagctaagttgcttttagctatacccattcatggcagtgtcttcgcctgcgtctccagaaacagagcctgattctacagggcaggagtaaagcaaaaggagtaaagtggaggcgaaggaagagccagtaccaggatggttattaatctggcctccactaagtatggctgattgcttctgctcaagggattatcctctgagaaatataaaatgagtctcagaatagcctatgggagggggaagggaaggaaatttatccatcagctcatctcattggataaagactcataccagttgttcatgcataggtgccaagtgggcttctgcagtgtcccaaaactcagtgtcaacagggaacctagcaagaggcacatggcagggccacaaggcaaagtgctgtcagggtgcagctgtgtgaagtcagatggtgcccacgcagagcttgatgccacagcagctgctggaatgaaagatgattgatgctacaagggtgatgccagtgatgcaaaaatttttgtaccatatagtgtgccccatttccaaagggccccagaaaagcaatccttgagagctctgaagggagccacagaagggcttccagcagttctggaactttcttatagtaactccacaaaagaagagttgcatcccacccgaatctgttctctcttgctttcatgcctgtgttcacttgtctgtttcctctattagaccatgagcttctttattgttcttgttaatatatctgtgacaggaaaaacaactcttttcaccagcccatttcattttcctcctaggctcataaaaaaattacatttctcagtaatcaggtaggcccatgtgactgagctctgggtaatggaatctggacagaagtggtaaatatatcccatttctggacatcccccaaaaactcccgtgagatctttcaaacttctcctttcctcattcctggccagatgcaaaaatattgagtggaggactcagaggccccagaaaatggcagtggtggctcactgcatggactagaacgtctgtgctcacttgcactggattgtgttgtaagcaagagataaaatgtcacagtgtcaagtcactgaaatgtgaaggttgtctgttacctgtctgatacagtacttgtctaacttcatgtgattccgtgtcactccagggcagggactgtgcttgtaactcaagcacaattgcaatgcgtggcacatagtaggcatttcttgaaatatggacaagagtgaatgagctgatacttgagcctggtcttaaagatcagaggtagaatgccaagcaaggtggcaagtggaaagtgttccatgaaggaggtgtagcatgtgtagaggtagagaaactagggaaaatagagtctgttctcagcccagcagaagggtcatggatatggttagggtgaggctagagagaaggcaagggtcagatcacaaaaagtcttgtatgttacatgaaggagtttgaaatttatcctacaggaatcattcaaggatttaaaacaagaatgtgatgtcatcaagtttatctttaacaaatatctctctagctacctggaaaaggatggattagaaagggagagtcagaaatacaaaaaatttttaaagcagcatttcattcttcccaagttatttgtcccataagatgttccactaaaaagaggttttggggacaagttagtttgggaagttgagtatactgtagcccctcctggaggttcttggagatttctgttcacatattaaaaaccctgagaggtcctacattaatgaaatctgttaaagtttaatgtaatagttctcaaaattatttgaccacagaacccttttttcattgaacacctattaaaactggtatcacggccaggcgcggtggctcatgcctgtaatcccagcactttgggaggccgaggtgggtggatcatgaggtaaggagatcgagaccatcctggctaacatggtgaaaccctgtctctactaaaaatacaaaaaattagccgggcatggtggtgggcgcctgtagtcccagctacttgggaggttgaggcaggagaatggcgtgaacctgggaaagggagcttgcagtgagccgagattgcaccactgcactccagtctgggcgacagagtgagactccatctcaaaaaaacaaacaaacaaaacaaaaaacaaaaaacaacaaaaaaactggtatcacttaggactcaatttggctgcataaatatgagaaaatgatataataagattaaagtttatttctgtcttaaataaaagaaatttgggaagcaggccgtccaggggtggcatggcagctgtccggtaccttcaggaatccaggcttcaatgtttttgctccattatccttagctttcattcccaaggtcacttcatggtccaagatggctgctggagcaccagtctacatgtccttggaaggaaaaaggaaaggcaaagtggaaaaagtggagttgagtcccttaaacaaccttcctggaaatactacacattttacttttgtctcattgtccagaacttggtcacatgaccatgccaagctgcaaaggaggctaggaaatctggtcttttattttgcttttctatgtgccaagttaaaaattgggtctgtcactaaagagttgagagactcaactagcagtttctggcataatgccccacagaaataatgttccacagaacctaaattgggataaaatgactaagtaaggagattgattttttaaacatttttagcagctttattgtggtataattcacataccatacaatttgcttactgcaagtatacagtttgacgatgtttagtaaatttatacagttgtgcaaccatcaccacaatccagttttagaatatttctgtcaccctcagaagttccttgttccctcttgctgtcaatctccactcccacccccaggcctgggaaaccattgatctgctttcttctttggagttctgcctttttgagaaatttcgtataaacagaatagtacaatatgtagtcttctgtgtctggcttatttaatgtaataattgtgtggttcattgtgttgtagagtgttttgtcagtttgtactttttaaaattgcttgaatggcattccattgtctgcatatgccactccattgtctgcatatgccaccttttatttatcacttactaaatgatggacattcggattgtttccacattgggactattatgaataatgctgctataaaccttcaagtagaagtccttgtgtggacatatgttgtcatttctcttgggtagatgcctaaggagactggtgtttaaaactgaattcgttcactgaaaagacatttattgagtgcctattactgacaagtattgtgctagatgccaaggatacagtagtgaataaaatttgacacaaactcagccctcatggagcttgcagtctatagaagagaaaggcattagtccagtagtcatgcgaacaaacgtaacatcacagcagtggtaagtgtgtgctataaaggaggggtataagatgctgtgagagattatgctagaaggatctgcctttgtcaaggaggtcaggaaagctgcccttgagctgagttctgaagtgtgtgagaatgtagtcactctgatttctgtctttcaaagtaatatcttaagaagccatatacttatttccaataatgctgcccttgcaaacatgtctgagccagtttatagacacactggtcttgggcctatttgtgcttagataaagtctctgtgttttaatctctcagagtttttgaaaactgtgaagcaagcacaacgcactgtcagtaaaggtaccttttcagtcatctctctctctctctttttttttttcttcagagacaggatcttgctgtgttgcccaggccggtctcaaactcctagactcaagcaatccttctgccttggcctccccacacactgggattacaggcatgagtcactgctcccggcccatctcttatattattttctgtatgtttgaaatatttcatgattaaacatcttaaaaatatcctttttagttcccttgagaattgtacctgccaagcagcccagcctgtcttgtcagaccctgaccttgttctctctctgtgggaagaggagacatgatcagaaggtgatttctggaacctggaactgaggggatgatgctaatagccagtattctggaactacactggtccaatccctgtatctctactgtaggggtgaatctgccacaaggcatcctcctgccagaagctccattctccagcacaaagctggataagactagttaagcccacaggctttgaagccctacagatgtggttcaaatctcagctctaccactagtgtccttaagaaagtcacttaacaggccaggcatggtggctcatgcctgtaatcacagcactttaggaggctgaggtgggtggaacacccgaggtcaggagtttgagaccagcctggccaacatggtgaaaccctgtctctactaaaaatggaaaaattagctgggcttggtggcacacaccactgtaatcccagctactcaggaggctgaggcaggagaattgcttgaacctgcgagatggaggttgcagtgagccaagattgtgccactgcatgccaacctgggtgacagagtgagactccatctcaaaaaaaagaaaaaaaaagaaagtcacttaacttacagtttcatgattccaataatagggttgttgtgtggattaaatgattcatgcaaagtgctttgcacatggcaactgctcaacaaattggttattaatatataattatcgcagcctttcctctgcctcccatttccccgtgttctgtatagactttccccctttgtcgacctgcaggttttgaaacatattaattccattgatttaactgaagtcaatctctgttcttgtgtttggcttggggaaccttctgtcttttggagtgccttctactgatatatggcctctacccctcatgtattaatctcactgatttaactcttacagtgccacagagctctcactctcacccatgtatagcactaccgctattttgattttttaaatccaaggttatatataaaaatgactgtggtccctttcagttactatgatttatggaaaatcacacctcaaatgttcttgggcaggatttttcaaaaacgctggtcacgctaccctgaaacagcttcgtaaatccttcattcttgctcagcagtgtactttcctgcaatgaccattagacagtttcagccataaaaacttgcttaaggccgggcgctgtggctcatgcctgtaatcccagcactttgggaggccaaggcgggtggatcacttgaggtcaggagttcgagaccagcctggccaacatggtgaaaccctgtctctactaaaaatacaaaaattagctgggcatggtggtgtgcgcctgtaaccccagctgcttgggaggctgaggcaggagaatcacctaaacctgggaggcggaggttgcagtgagctgagatagcaccattgcactccaacctgggcaatagagcaacgctctgtctccaaaaacaaacaaacaaacaaacaaaaaaaaaaaaaaacaaaaaaaaccacagcaacaaaaaagttcttaagctttttactaagcctcaagttgctgtagaatccttttctttatgtgtgcaattctaccatcaacattactgaccaatttggtgaggctaccgtctgaaaactggtaataaaaataagcaacacagttttacatactagaaacaaaaaactatagttttaaaaaattaattagtttccatgtttttgctgaggtgaagcatggtaactgtccttccagttggcccccagtgatactcacttgctgtgattcaaacccttatactgccctctcctgtactgaatagacctgatttatgtatgtaaccagtaggatattgcagaagtgacagagtgtaacttccaatgctagtcataaatggcattgcagcatctgtcttgctgttttgggtaatttgcaatgggaagagtccattgtcatgacatgaggacattcagtcagccttatggaaaaagtctttgtggcaagaactcaaggcctcttgtcaggaaccatgtgaatgggccatcttggaagtagatcctccatgcctagtcaagccttcagatgagactgcatccatccccagccaacattttgactgcaacctcatgaaaacctaagtcactctcaaatttctgacctatgaaaactatgtgagataataaatgtttattgttgtttttaagccaccaagctttggagataatttgtaatgcagcaatagataacagtatttccttgggtgatacaactgacagccatcattaagttactgtatatttaaaatgtgctttgtataaatttgccccacattttaagtgttttcttaacatatgatctacatccagatattttaggttattctatgactcatttcagtcccattcagcaaacatgctgtattagtctgttctcacactgctataaagaactacctgagactgggtaatttagcaagaaaagaggtttaattgactcacattactgcaggctggacaggaagcatgattggggaggcctcaggaaacttacaatcatggtggacgggcaaaggagaaacaagcacatattcacgtggcggcaggagagagagagagaaagagagagaaagagaaaggggaagtgctacacacttttaaacaaccagatctcatgggaactcattcactatcatgagaacaaaaaggaggaaatctgcccccatgagtcaatcacctcccaccaggtccttcccctaacattgggaattacaattcaacatgagatttggttgaggacacagagccaaaccgtatcacttgcattgcctacttgtatcaaagcctgttcgtaacagaaaactccagatcaaccatcagcaatttgaacgaaactgatggcagtaagttgtttttctccatccaattccatttattgtgaatgattcttatgctttcatgattgtagttaaatctctggatgccaggaagtccagctcctaccacttcttttgcttctttttggaatatatgccagaagggaataaagttgaagagaatgatgcccccatgttactaaaacatgcactgttacattgacagttcataatagctaattttattgcataattaatatgaactaagcactgcttttaaaatttttaaaaataatttcaatttttattttagattcagtgggtacatgtgcaggtttgttacatgtgaatattgtgtgatgctgaggtttggggtgtgaatgatcccgtcacccaggtggtaagtatagcacacaataggagttttttcagtccttccctccttcctccctcccaccactagtagtccccagtgtctattgttcccatctttatgtccatttgtacccaatgcttagctcccacttataagtgagaacatttggtatttggttttctgttcctacattagttagcttaggataatgacctccaattacatccatgttgctgcaaaggacatgattttattctttgttatggctagatagtattctatggtgtatatgtaccacatttcattatccaatccaccatggatggccatctaggttattctatgtctttgctcttgtgaatagtgcagtgacgaatgtatgagtgcacatgtctttttggtaggatgacttattttttggggggtatacacccagtagtagaattgctggattgaatggtagttttgagttatttgagaaatctctaaactgctttccacagtggctagactaatttacattcccaccaacagtgtataggtattcccttttctctgaagcctcgccagcatctattattttctgactttctaataatagccattctaagtggtgtaagatggtatttcattgtggttttgatttgtgtcttgatgattagtgatgtcgaggtttttttttaatatatgtttgttggccactcatatttcttcttttgagaaatctttgttcatgttctttgcctactttctttattttttggaggcaggatttcattcttttgcctaggctggagtgcagtggtgcgatcatggctcactgcagcctcaacctcctgggctcaagcaatcttacattagcctcccgagtaggtaggactacaggcatatgccaccacattgtagttttttgtagagatggggtttcacaatgttgcctaggctggtctcaaacttctgggcttaagtgatctgcctgccttggtctcccaaagtgctgggattataggcctgagccactgtgcctggccctttgcctactttttaatggggttgtttgtttttgctttcttgatttgtctaagttccttacagattctggatattagacctgttttagatgcatagtttgcaaatattttctcccattctgtaggttgtctgtttactttgttgaaagtttgttttgctgtgtgaaagctgtttagtttaattaggtcccacttgtcaatttttgtttttgttgtgattgcttttgaggacctaatcataaattattttccaaggccaatgtccagaatggtatgtcctaggtattcttctaggatttacttatagtttgaggttttacatttaaatatttaatctatcttgagttaatttttgtatatggttaaaaagtatgggtccagtttcattcttctgctcatggctagccagctatcccagcaccatttattgaataggaagtcttttcctcattgcttatgtttgtcagctttgtcaaagatcagatggctgtagctgtgtggctttaattctgggttctctattctgttctgttgggctgtgtgtctgtttttgtaccagtaccatgttgttttggttactgtagccttatggtatagcttaatattgggtaatgtgatgcctctggctttgttccaagcactgttttaaatgctttacatgtataaaatatttaattcttacaaagaaaaagttattaccctcattttacaaatagtaaaactgaggcacatcactggaaggaaggctgcagagtctagagctatcaccatctctgtctgtcagccacaagcccaggtgccaaagtgcagcagtagctgccacacaaatagcagttcagtccagtgtcctagctttcctaggctcccgctctaggtatcacaagcaaaaacaaggctaggatttgacagaaggaaaagtgaaaagaaagcaccaacaaagcatacaaacaaaaacatttacagaacacagatgctgtgatggttaatgttatatgtcaacttgactgggctaagggacgcacagatagctggagaaacatttctgggtgtgtctctgaggatgttcccaggataaattagcatctgaatcagtagacttaataaagaagattgccctcaccaatgttagtgggcatcgtctgttgagggcccaaagagaataaaaatatggaagaagagtaaattccccctctccttgaactgggacattggagttcctggttctcaggctttggattctgaaaactacacctgcactcccctcacctctactctctgttctcaggccttcaagcttgaactaggaattatatcataagatctcctggttctcaggcctttggactcatactgaatcaaacctctggatttcctggttctacagcttgcagatggcagatagtggaaatattcagcctccataatcatgtgagccaattcccataataaatcttcttgtgtgtgtatgtgtgtgtgtgtgcatgtgtgcatgcttgtgtgtgtccttttggttctattctctggagaaccctaattcagatgtcttatagtaattttaaaagatgacgccaggcgtggtggctcacgcctataatcccagcactttgggaggccgaggtgggcggatcacctggggtcaggagtttgagaccagcccggccaacatgccaaaaccccgtctctactaaaaatacaaaatttagcctgatgtggtggcgggcgcctgtaattccagctactcaggaggctgaggcaggagaattgcttgaacccgggaggcagaggttgcagtgagccgagattgtgccagtgcaccccagcctgggcgacaagagtgaaaatccgtctcaaaaaaaaaaaaaaaaaaaaagaacaggaccgggcaggcacgatggctcacacctgtaatcccagcattttgggaggtggaggtgggtggatcacctgaggtcaggagttcgagaccagcctggccaacatggtgaaaccccatctctactaaaaatacaaaaaaattagccaggcatggtggcaggtgcctgtaatcccagctactcaggaggctgaggcaggagaatcgtttgaacctgggaggtggaggttgcggtgagccaagatcgcgtcaatgcacttcaacctgggtgacagagtgagactccgtgtcaaaaaaaaaaaaaaaaaaaaaaggatgaacagcaacagcttagctttactggcttaatggttctccaagtgtggttcctggaccagcagcagcatctaggaacttggtaaaaatccaaattcttggactcaacccaaaccaactggatcagaaagtttgggggtggggctagaagcctgtgcttaaatgcatgctgaagtctgagctccaccgacgtaggggacccagctgtggctaaatctgggctgtgtgactcagagcccatgacaactctggggagtcattacagcgccaattttggagtccaacagcaacaatgaaagatattctagccaaaaagaaacatgactgtcattccttcataggaatggaataaagcagggatcttcaacatgcctttgatgccccctgtcaaacacagattcctgggctaggatgaagggtatccacctaacttaacttgaaaatatggattaagtgccaactgtagtggatgaaagcatgttgagaggaggctgaaagaggccaggtcactttagagcaaattaggtagtataatattcactagctgctataataaatatacacacaaaagaataatggctccaacaaaaagaagtttattgcttgcttatatagtacttcaaggaaagtattttcctttctttctttctttctttctttctttctttctttctttctttctttctttctttctttctttcttttctttctttctttctttctttcttttcttttctttctttctttctttctttctctctttctctccctcccttccttcctttctttctttcttttttttttttgagacagaatctcactctgtcacccaggctggagtgcagtggcgcgatcttggctcactgcaacctctgcctccccggctcaagcgattctcctgcctcagcctcctgagtagctgcgattacaggcacatgccaccacgcccagctaattttcgtacttttagtagagatggggtttcgccgtgttggccaggctggtctcaaactcctgacctcagatgatctgcccgccttggcctcctgaagtgcggggattacaggggtgagccaccatgcccagtctaaaggaaagtatttctggttgacaagtcacaatcctctacctagtgattcagggggattccttctacgccataactacatcatcccctagggttttgtcatcttctgcatccaactagcaagaagagattgtggttaggacacacccccttttaaaaagcctagaaatcacacatatcacttctgcttatgtgtcattggctagaactcagttacatggccacaccaaaccacaagagaagctgaataatgtagtttgtatgtacccaggaagaagaggaaatgaatttttgatgaagacatagcaagatcttttatcaggaacagagtgggatgataaaaataactggattttgggctccagttatttagatagatttttaaaactatctgttttgttcttctccagtattctcaacacctgacaggtaccttgcagagctcagcaaatgttggttgaatgatggaaaacactggaaaaatgatgggaaatggtgtcacacctgtttctacttctccctccatatccatggagaaattctggctaatttaccaccttctttcttgctaatcctgtacttaacccccagaattcctatcaactcagagctccaggcagacattattattattattattattattattattatatattgttttgagatggagtcttgctctgtcacccaggctggaatgcagtggcacaatttcagctcactgcaacctccacctccctgcttcacgtgattctcctgcctcagccttctgagtagctgggactataggcacctgccaccatgcctggctaatttttgtatttttagtagagccgggggtttcactatattggccaggctggtctcaaactcctgacttcaagtgatctgcttgccttggcctcccaaagtgctgggattacaggtgtgagccaccgcgcctggccaggcaaacattattagtcaactaggaatggctcacagtatgaaacctaattggtatcttgggacattgactttttgctatagtcatttcatctgtaaaactggtatgagccctgtgtaggcagtttctcagaggtgccttttttaaattattattttttatttttatacacagggtcttcctgtcacccaggctgaagtacagcaacatgatcatagctcactgcagccttaaacttctgggctcaagcgatcctacaagtagctgggactacaggtatgcatcactgtgttgtctaattttttattttttatttttatttttgtagagatagggtctcactatgtttcccaggctcaaagtataaaccttttatgtataattcactgatgtcctagtgctggccagagcttatgtttataaaccagtgatcttacattgttgaaatgttagttccttcaaaatcttttgactcagggctctagaatcatccaactgttgaggagtgatatcttcccagaccagactgctgatcagtcacaaggaattgtccttcctcattcatttctgaaatattattttggccaaggttctgataacatcacattttccattacatttttcttgaaaggttttgaagtagtataaactatgccctcatgggccagtgttgagctccatgaaggagtctcagcacttctgcatacccaacaaatgaatggtacctccaggagaggagctgggccactctaactcacccaaacaacttcactccagtttcaacttatgagcttgatggattcttgaccttaaacatgttcagaaatctagcagtcatttaaccatgcttctcagtggtcacgtcttgacatgatcactcatgaggtctatggccagtaatttgttactaattgtatataagtcaccacagtctgaatgatttgccttctttaaaaaaaaataaataggaggctgggcgcagtggctcacccctgtaatcccagcactttgggaggccgaggcggacagatcacctgaggttgggagttcaagaccagcctgaccaacatggagaaaccctgtctgtcctaaaaatacaaaattagctgggcatggtggtgcatgcctgtaatcctggctacttgagaggctgaggcaggagaatcgcttgaaccccggaggcggaggttgcggtgagctgagatcgcaccattgcactgcagcctgggcaacaagagcaaaactccgtctcaaataaataaataaataaataggaacagttattcttataataatgtcattcctattcatttgcattctgacatgctctcctgagcagcagggcagagggaggcattttagctgagcactgggaatttcacaccatcctcagtctaacttatctacatctcagcctgtgatgagagaccattaacagttttgacaactataaattatggtagtgtttgtgagtggtgatatttatggttactgccactgcttatccttttgcttcagtagtatatgccttctcaccttattactagtacctgtgaggggaaagcctggggaaaaaaacaaaacttgttgttaaaaataaaactggccatatttgtttagcttttttcttatataatggcagtttttgagctctttaaatttttttattattcaagtagttgcaaaatgcttttatgaccatcacaccacaaatattttacagaactatttgtcttacttccttggaaaaaatacccagcatagattgtgaggagtatgggttgcatctaaacctcttcacagagagggagggcgtgtggcagaaaagatactgggacacacagttttaacccagtacctccctacacactcacatattgcagggttacctattgccctcactccttctgggcataaccaggagaaaggcatatctgggtcaatacagacaaagtcagtactggcatggctctgtaagctaagtaagattctggaaagatccattggcatacaccagtacaaagtacctcaggcaaaaccgagtcagggttaggagctacaatcaaataaaaagatgattgagaagaaatgacaaagatccaggcagaatgatctgttttggtaagttggtccaaattgtggagggagagagagagagagagagagagagagggagacagagcagaaacagggacagagagatggagagagggagaaagaacagggagagagagagagacagagaaagtgtgtctttgtggtcttagaagggtactgtttattataattgaagggtcagaggcaaggcagataagggtagctcatgaatgattagatggagggttgaataaatggataaattgatgcatggatggttggtgaatgaatgaatggataaatggatttaatgaaattaggatggatggctgatgttactgataaatgaatggtgggcaagtgaatgattagttagatgaatgaacaaataaatggacaactggattggatatacgtacggatagaaagatagatagacagacagataaataagtacatacatacatacattgtgagtgaatggatgaccaaagtgatggattggtggatgaacacaaagatgtattaatgaatgaatggaaagatgaatgcgtaaatagatggacgttatggtaggcagaataatggacccccaaagatgttcatatcttaattactgaaacttttaatatgctagattgcatggcaaaaaagaattaaggttgctaatcattttatcttgagatgggtgagattaccctggattatctgtgtgggcccagtgtaatcccaaggctccttataagtacaagtggagcagaagggacagagtcagagagagatgtgaagatgctatgctgctggctttgaagttggaggaagaggcgatgagaccaggaatgcaggcaagctcaagcaggaaaagtcaagaaaacagattcacccctacagcctccagaaggaatacagttctgtcaacactttggttttggccccttcagacacattttaggcttctgacctctagaagtaaaagataataaatctttattgtcttaagccactaagtttgtggtaatttgtcaccacagcaatagaaatgattgaatacattaatgggtaaataaatggatggaagatagatgaatacttggatgattaaatggatgaatgataaatggataaacacatggttgggtgatggagagaatggaggaatagatacatgaataaatgattggttggctagaggaaggaataagtgaatacatggatacatggatggagaaatgaatagatagactcatgggtaaatgaaagaataggtgggtggattgatggataaatggatatattcgcacacagagagataaaatgtgttagatgtatagatacatggagggatggttgtctggtggattggtagacaaatacatggattgattattggtatgatgaatgattaaatagatatatgaatgggtaatcagtgaatacataaataagtagatacttggttagagatatgattagatagatgggtatttacgtgtgtatatatgcataaatacataaaaagcctttcatggccgggtgcagtggttgacacctgcaatctcaacaccgtgggaggcaaggcagagtattgcttgaggccaagagttcaagactaggctgggcaacacagtgagacccaatctctacaaaaaatttaaaaactacttgggcagggtgctgcgtgcctatagttccagctactttggaggctgaagaggagaattgcttaagcctgagagtttgaggctgtagtgagctatgattgtgccactgcactttagcctgggagacagggcaagactctgtctctaaaaataaaaaaatcaaaaataaaaaataagctgggcgtggtggctcatgcctgtaatcccagcactttgggaagccaaggcaggcgggtcacctgaggtcaggagttcagagaccagcctggccaacatggtgaaaccccatctctactaaaaatacaaaaattagctgggtgtggtggcgggcacccgtaatatcagctacttgggaagctgaggcaggagaattgcttgaacgtgggaggcggaggttgcagtgagccaagattgcgccattgctctccagcctggacaacaagagagaaactctgtctcaaaataaatacatacacacatacgtacatacatacatacataaaataaagaaaaagaaaagtatctcatgcttagagacaaacactatctttgacatgaaatgtggatatgctggagattaggggagtttccagttaggaaaggagacatccagataaactgtaaattgtgtgtaaagctctgaacgtggactaagcctccattctccaggatgaaccagttaaaacaagggacctttgcacttgatggtttctctatctggaatataatactcttcctttaagtaattaacttctaattccctgcatcacagcacaagcattgctttctcaaaggagccttactaaatatactcttatagtattgtgtacctttgctttggagcgcttattaaattagtagttttgcctttatttgtatgttcatgtgattagtaaccatctcctctattagactatgagctgcataaggacagagatcaaaatatttttgcctaccattttctccccatctcttaggtcatacctggcacatggaaaagtacccactcagcacttttttgaatgaatgaaaaccttcctgtggcattcccactcaggaaagatcctgatgggttgctagggcattattaatactatggcaatgaagtctggctttcctgatggaagactttgacagggagagtatttctcctaaatggaaaagccaaccagcaggttcaggactccctcttcctagagtcccctctgcctccagagagaccagagcccctgtctctgggccaggtcaaccaactctttgctttcactcagatcctcctcacttggctgtccttgaaccagcatcctctctgacttgacgaggttctagccatctcccatcctgaactccgtcagttccagctccagccacctgcccctgccttgctctaggctggtagattcggaaaccctacctcttaccaaaggctagcacatcctcttctgtcactctgatcatccttctcttttctcatctccagttagtttcactttgatcttttcagttatctgctagacttcagtttgagttttgtgatctgttcttcccttctgtacccagcacactagggatctaagagaactgcactcaaatcccaactctgcatgaactagctgtgtgcccttgagcgagttacttaacctttctgactctcaatttcctaattcatgaaatggatgcaataaatctatgtccctgggtggttagaggggattaaacaagatgatacacatgaagcatctcgcacagtgactggcaacagtaggtgataatcaattattaatttcctttctttcttcctaggtttgtctctcttacttcttcctgcagcacaatagcaatctctctttctatttttcccttttctgtctacagaatgttttctagccctcataaaaatagcagcacatgaaatgaaattgcacagtatttttatatcttccaaataactcaattcaattatagactggtcaattttagttatttgagcattaccaaagcatctgaaactggtaaataaagttctgtattcacattcagaaattaaagagctaaatggatactttggagaagcataaaggaaagatactttccttgaggcttaagaccttatatggaatgtgtcagcctaaagctaatccttctggctagaagacaatgcacaggaaacccttatagtttaaattcaacacagccgcaatgaagctagtggaagaatgaaggctcacattttctgggaagaggaatttggcaggaggtccctgtgtgttatccacagagtcctcacgtgcatgatttagtgcaggagatctgaaaattcagagagaaagggagaagttaatgggaaagaggttatcaacttattactgggatggttactagaataattggataatagtttgaagctccctaaactaaatggagatttcaagacagggtcataatcaaatattacaaatgcaagcacataagaaagcagacagtccagggttcaaatacgggcagcaccagtttctcgactttataattttggtaaagttactccatctctctgggcccctgtttcttcatgtgtaaattaggaactaagattgtatacatcagccaggcgtggtggcttatgcctgtaatcccagcactttgggaggctgaggcgggcagatcacctgaggtcaggagtttgagaccagcctggccaacatggagaaacccccgtctcccctaaaaatacaaaaattagctaggcatggtggtgtgcacctgtaatcttagctacttgggaggctgaggcaggagaatcacttgaacctgagaggcagaggttgcagagagctgagactaccccactgcactccagcctgggcagtacagaaagacttcatctcaaaaaataataataaataaaaagatcgtatacattacagaagtgtgtggctgttgaacagttcattaaatgcaccaggaacagtgttgggcacctagcaagtacttaattagggggtagggttgattctgaattattattagttatggagtttctggcacatttaccttcacagcttattattgagaaaggtatttgcacagtaatggaaatgttgggggaattatctctaagaaaaggtggtaagactaacatttctcagcaaggtctgggtgaattacagcctagagtctggctatcagacttatagctcaaaaacctgatttttttcagtactgagaagagatctatctctagggcagattcatactaatcaaattcattaggccaatgttttaaccagatcatagtcaattaatttccaatgagaaatacagcttttgaaaggaccagaatactcaggtcagtgtgatcattttctccctgggctcatacctattgggaagccaaatcttcaaagacaaactacataatataaaacttagagctagagaagtgagacttaagagatctaaatgtaaagtgggttcagtctaagctagcccaagccagacatctcatattagggatagcctttcccacactgtatattgtgaaactttagcctctttgccaagccaaaaatggaaaacattcattgatgattttgactgcataaaaaaattttaacttctatacagccaaaataacataaacaaagtcaaaagacaaatgacaaactagaaaaatatttataacacataggtcaatcaaaaggttaaaatcaaatacataaagagctttttttaaaaattggtgaaaattttttatgcaccgattaaaaaaagactaacactgtgtcagaaaaatgaacaaaaggtaggtatgagtaatttacagaaaaagaatacaaatgatttatcagttgtgcaaggaagcacactgcacttacagtgaaatgcttgataaactttgtcaagctgataaatggaagttatattttattattgttacaattcaccaatttggttaatgaaatttatatgtgtatggctgtgtatttttatgtatgtgatattaaatttgtaatatgattaatagctattaatatatatttttattaattacatctatcttttgcctattgctctattgggctattcttcctcttattgattaaaagagctctttatatattcaggtattaacccattatgcatgttaaataaagcctcctccccttctctgggcttcttgaggcaggttcatgggagagaagcagaagataattccctttaaatgaacatccaatatgtaccagattctttcacatggattatctcatttgtccttaaaacattcctagggagcaggtgctgtgattcctactttatagctgaggacccagtggctcagagaaactgagtaacttgcttaaggacatacagctagtaagctgtatttgaactctgaacctaaaaatgtgctctttcctcttggtcatgcaagtggcttcccagaaggctcccagctcttttgaccatcacctaatctctactacaacatctggggacccagttgatgttgccccagatcatacctgaaccaataccaactgggcaggggctccatcagaagcaatgggtaggttaaagttagtcatactgcccttgttccagcatcctgtgtgtttggggttgagtcctggacatctgagtacccactgaaatgcaattccctcttattttttgcttagtttccctctctgcctgaggtcagaccagattttcctcttacacttaaaaaaaaaaaaggaactcaaactaaacagcagcaaaccatctcccctccttaagaggaggaattgtaatttgattggtttaagtgctaggtgggatcactaaaaccatatccaggaataaggtcttttcttctgcctgctgtcaacatctgcagcatttgcactcaatgtattagtcccacccagttacctacagtgccccaaataggctttgctctaacacgcctccatgcctatgtatggactactctttcccacctagcaaatgcttttacctccttcaagttccatctcacctctgctatggagaaccctcagaccctcctttccactgtgaaggacccccaggccctgctttgaaaaaaggcagagttaagtcctcttcatctgtgctccacagcttctgtgctcacctctgccactgccttgaccatgtttttgttgttgatgtttgttttttagagacagggtattgccctgtcacctagctggagtcggctccatcatagctgactgaagcctcaaattcctagtctcaagcagtcctcctgcctcagcctcctgagtagctggtactacacaggcacactaccacacctggcttttttttttttttttttttttgtaaagacggagtctcccatgtttcccaggctggtctcaaactcctgggcacaaataagtgatcctcctgcctcgggctcccaaagcactgggattacaagcatgagccaccatgcccggccccttgaccatgttttgtggtagtttctgtttaatgtgtctgggggattccccactgaactcaagcagggatttccttcagagcaggagccataatcaaccatctcttcatctccggagcccagcacaggataatgaatggatgaggatgcctctgagtctgaggtctctccttcccacctagcctatgcccagactcacagagctggtttctgctttgtatctcactttgatttgcttgtctgagtaatttgcttccttccccagctctctagaaagattgcttccatctcaatcttgctatgagggcccaaatacttcttgatttgtatcacctgcttctggtctccttatcactatttctggctgcctgttgggagaatcttgaagcctgggcttcagtgacaacactgtaacctcttaaacactttctgagctggtagagttctcacagcccctgtcctgttcctggagtaagtacaggaccaggccctaaccctcccagccctctctatggtcttatgggcatgaggccaggcctcttcatgaccgtaagactcaaacctttgttccagcttcactcctatcagtctgcccctcctacaccactccaggcacgcagaaggcaaatcagctgagtcactctcggccaggagttctgcagcatcacaagagaaatcaacagagcaggaggaaattggcttatttcacagagaggcacttggagcaaccaggcagcccaaagcccctgggaagccaggcaaaggaccacctaggtcataactgcatcctctctgctgttgtcactctttggagaaaagtgttttcaggacccagtcctcagacccattcacacctgagccaactccatcagaggagagggaggatgggaccttaccaggctatggggtctcgaaggtgagctgctggagcaagggatggaggactagtaagactgtttgttctaaactctaggggaaggatgtttgaaggttgttgctgagttagtctttagaaacttactgacactcaccttggccagccccaaagattactgagacataattcctgccccagatggctcatagtctagcaaaagaggatgttaaagctttctaggttgggatcttgtagaggaaagaaaatacaagtagagacagagaagtacaaacaaagcccgctggtgtggagtgtagttgaagggagagtgcattggccagagagttggaagagctgatttcattttttgaaatacgtattgagaagttcagatagttgcggtacgatgggagtggaaggagatgaggctggagaggtaggttacaagaggggacttggtttggaagaccacgtctctacagtggaacatttactgagttaaggaacacaggttgagcaagcagacctgtgagtgaagatgacatgcttaggtttgcccaagttgaggctgaaatgcagagtgggctccattcgctctgtgtttgccacatccttagtctttctgaggaaggtggctctagacctatagtcctcatacaggactctctatgaatagtaatcagcagatttaatcacatcctcgtttgggaagtttggatctaagagataaacagcagaatggcctggaagttgagagaaatgcagaaaatgggatcacacctgtaatcccagcactttgggtggcggaggtgggaggattgcttgagttcaagattagccttagccgacagtgagaccctgtctctacaaaaaaatattttaaaaaaagagctggatgtggtggtatgtacctatagttctagctacttgggaggctgaggcaggaagattgcttgagcccaggagtttgaggctgcagcgagctataatcatgccactgaactccagcctgggtgacagactgagaccctgtctccaaaaagaagaaaagaaaaagcagcagcagcagtagctatggggtttttctcgtgctgttcttgtgatagtgaataagtctcatgagatctgatggttttataaatggcagcacccctgcacgtgctcttttgcctgctgcctcctaagacatgcctttgttcttccttcgccttctgccatgatcgtgaggcctccccagccatgtagaactgagcccattaaacctctttgctttataaattacccagtcttggggatgtccttatagcagcatgagaacggactaatacagatacttagtagccaaaaatagtaaatatcctcttctgagatcagttaggtctccctccagcctaggtcaataaaatccttcacattattcaatccagcacaatcagaggccagaacctcagagaaagaaagtgtgcattgtttgggcttattctctgggctcatatttctttcaaaggcttggggagaagggatgggcagtagtcgctgtggcaggacaggtttcagatctcaggaattttgggcatcctccaaattccattatccccaacaagactcaactcatcacagttggcaaacaaccctggccaagacagctccaagttgagaactgaagggtgagtagctgataggcaagtgaggggaggtggttagaatattctaggatatgcgaaggcttgatgcatttgggtaactgaaatcgattccatatggctgggaaggtaagcacaggaaatactgggatgccatgaactagagaggaaggtgtcttagggagtttggattttatactgaggacagagggatgccattgatgtgctttaatctggggaatattagtttcatgatgatgacggctttgttttgctcactaccatatccctagcacctaacactccataggtactcagcaaacaactggaaatgaatgaacggatgactgctgtgcagaaaatgtgtccagaataatcagtgaggaggtgactatgtagtccaaatattaaatcacaggtgacctgggctgtggggatgaagagaagtgcacagattcatggcatgtttgggaggtagaataaattacatgctggtacgggcatagtgatgctgatggtgggaagtgtggtatcaaggatgagatcctggtttctaacataacaactgaatagctgaaggtatcattacctgagatacaaatgactggaggggtaggtcaacggtagagtaacaaattcatgtgccaacacatttagctttaggtgtccatggaacatccaagtggaggcttcagctgttgccagtctttgccctggagaagcacacctagacccagatggatcacaggtggagctttagcctcccctctggagagcaatgccagggtctgtgccagcaggggcacctgagcccagtgtgctgggaccctgacccagtctctgctcttgagtctgccattcaatatctgtgagtatgcattatcaagggcctactctgtgccttctcctgacattccccgctccccctcccattcctagactcatcatttcattagtactgtagggaggatggccagcattgctttgatgaggactgagcctgaacactgcaccagaactgctttctcagaattatataagctaggacagaatgcaggagcctcgatttcagacagcacagactgacaaaatggagtgctcagatcatgttgtcttgcttgtgtagttaaaatagcaaaactaaactaaaacaaatcgcctaacaaaaatgtttatttatacacattctaacaccttagataagaaaaagaatcctgttttatcattgcactgttgtcatgtcactgcgtcactcccccttctctgggctctgatgtgaggccagtctgccttacagtcatcagcagcaaggaaattacagaagagaaggcagaagggttggggaagaacttggtgatttgagttcgtaagtcaccaagtggtaactgccctgtttcttctctcgtgtctctggggcctggatgtttgggggtgctgggcattgcttctgcctgtgaaactgcagttttggggttactgtatcccttctccctacaaatttctgtacaatttatgagtacaagacagtgtcatcaacacaaacagtaaagaaagaaacagtcctgttgattacatagagagcacgatcaagatacaaagcgttttctagtcgagaagacttccctattgtgttttgtgtgataatatataatttatcacacaaatttaataatttaataaggaattaaaattgtgcataccttttgaaccttgatatacacatattacatgctatttatttaaatgctaaaatcgttttattctaaacattaaataatactttagcaaatataatttaaataatgaggcaggtgctgtccgcattctgtgtcctctcagatccgttccctgtcctccttctgctttgctctgtgccacagtgagaccgacctcccagcctcctttcttgggctcctctgccagctgggttacagctagcttgaacatgggaggcaagagatgggaggacaggaagaaaggagacccccaggtgtttctccccgcctctgccacaggtggcatcttcagcagttgctgcatcttcttcttgactccagctctcatcagatgtgcttaccatggtcccagtttgctccagtgaccctaaaccctgagcaccagtaacatcacctccttttgtccttacagcctagggctggtaggggtttctgctattgctaagctctgagttgcttcaccatcttcagtttggcttatcagctcttctgtcacttggaaacccaaatctcagcattaaattgcctgttttcaatactttgaatggttctgttttccattctgttgaaccctgcctcataaatgcagtgttatttaaaagggatcacggatggaggatttttgttatttaaactgagaatggccactttctgaaagaaggtgcaaggaatcagaagccaaagtttgcctggatcttgtaggaatatggcggggggcgggggttgggggaggatcttgagcttcctggctttaaaattaacagctttggggaaaggatacccaggtggcagagaacgatggtgaaagggccatccctatccagtagtactctttggtgtctaagagacagacttaggctaacttaagcaaaaagggatttattggaagactataagaaaagtcacagaattgtaaagaaagctgaataggtcagcttttggaaagaggaaaaagggcatctcagggatctagggagtaggaattagcagtccttttaggaagcttggatggagtagctgtactataaggtcatcactttcattcctggatcattctgctcaagattcaaaatccagagagggaaagggtccaatgggttcagcataaattaagtgcttgctattgcccaggggagagcaggaccccgaggttatgtgcaatgcaggcagagattccccccaaagaaagaacagcttgaaaactgtgctatttgcaccctgggcctaccataaaaatcagaagtagggaatgaagaaatggcccaaggcaagtagaataatcttcctctacagccaagaaactagccaagaacccaaatggtggttaatctaaggatccagtggctataccttgagacactggctggggcccagatgatccatgtggacttgcttccacttttgtgccaaagacagctctgcctgcccccaagtaacttgggacccaacaggactaaaccagtcaattctggggatggatgagatggggatgcagtgggggggacagatcctcagacaggaggccaaagcgtaggacagggatagaacctactcactttgttcttagggtatgttagaggataacatttgtttgtactcagagctctttagcaaagagttatttaacatgcgatgtcattgtccctgaaagccacactcaagaagcacccaagggccctggtcaataaaaaaaaatcttatcttcactctctatggtggaattgttgggcgaaagcaatgacagcatgaaagggattacgaatgttttactgggatcaagtgggtatcagctgtgcccacacatgggggtatggcatgtctgggtatgtctgtattgagcttgccaaccagacatcagtttgcataagggcttcttgggagaaaactcacccttaaccaaaaggaaaccagagaacaagctaacctagtaaatggggccctcgtcttgggcaattctagttcaaagaggagacttccattcagatttgtgttcagtaggcacatgtctgaatcttaaggtggtggtggaggagggagacagagaggggagacacacacacacacacacacacagagagagacagagagagagagagagagagaaaggggagggatataataaattctgaaatttgaaaaatgaaaacatgctataagtgggaaaattggaagagttgccacactagatacttggtcaagccctgccttcaagcagttcagctgtggatctgtcattgattctcaaggcctggcatcttgtgtatctcagcatttttggcagtgtctggaagaagagagcataactgagcagatgcagctgtgctcactggagcgtgggtggagccaaagaagaatatacctgcaaagctttcaggatcacctcccaggcttgtaaatacgtgggcccctgaattatctgttgtgaggctgttatctagaagcaggggtttggggtttgaagctagggtcgagaaccatcagaatacaaagtactggagaaagaacattccaggcagagggaatggcagggcatggagatcttaatagcctgaatacgtcttgtagtacaggcccagttactctcatttgaaaaatgtctagccatcttcatctcggtggtgaatctgcagtggaactaccttggctggtacttgcatccatgttaaagaagcccagttttttaaaggctgagtatgtggttcaacctgggggccggctggcctctctccctccttctgaatgcttcccttccttcctttgtctgtgtccctttctctttccctcatcagtccttttcttctgtaagaccagtgctttgcagtagctaccttcaggaaagctgatggttcatgccttccaggagagaaagttcacaaattgcaacatggttttgtttttgttttttgttttaaagctgagcagcaggatcacagaacctgcaggtttgctgtctgctcagcaggacaaagagagcagagagaggaacatgaaaaccaagcggaccagaagaaaggaaaacatgaaggaggctcatttaaagggggaggagactttgcttaagatgctggcttgggggagggtgactgcaccaaacatgtgctgtttccagggtccagatggtgtcatttgccctgcaaaacaagtaatagacaacatgattttgatgctcagaaataaatctgtgagtaagtcatttgggggaaatgatgcccatggctgttatactcacaacagaagagattcaactacatttgaaaacaactgccctgccttgctggcctctagttcatttaaatgctgtatttacattgttaccagctgtatttgcacagctagaacttccacctgcttgataatttacttaaggtacatattgtatttacatgatatagaccagagtagggaaactggtcatacctgtttggggctggaaagagcagcagctcatctgaaattttcatcttggcagacccactgcctttgctataggtgctggcacatagtaaatactgtataataataataataataataataataataataataataataatagttaactctcatggaatgctttaaggtatggagagtttctataacttacccacagttaaacagctattcatgtactaaagccagcatctgaacccaggctggatctggatgttttagtactggttgttcttcagcataaagacccctgcttcaagatggcagattgaacaagtgcaattgattactaaccctctcttccaaaaccctacaaaaacaacactgcaagaaattgtaaaatgtttaaatgtacgaagataaagagtgtgggagagcagacatatccctatccctaagcagcaatacaattttagaagctggaaagcacatgaatgaatggtggctgacttcgcagacccagaaagctgaatcctaaactggcagtgagaaaagccaagaaacagcaacctgatttcatggcagaaactccccaaggctcaggaattagtggcaccagatggggctgaaacaggaagattggttcaaagtctgatatgcagattcctagatcctttcttcaaccccagcagaagattgcatgtttattttcttgtggaggtaaaagagggcttctgaatcgggggtgccaggtacaattgagggctgggatattccctgataatagtagggaaatcagatttaaatttgcatactgactgtgagattcccaccattttcttctcttctctcacaactgctagaatgcttgtaaccagaattattacccttgaggcaggagagtgggagacacttttctctgggaaatatgaccagcctgagaaggcggacctcacaaatggatccaggaggatcaccaaacagtgaagcccatagaccacatgcccaagccaagtgcaaagagcttttgattgggtttttaatgctttactcttaagcatgaccaggcaacctaaacacttaaacctaagcctaacccaaacatcgaattatccaagcaactattacagagcaaaaggggctttctgcctgatgcactagaagccattactaagacgccgggcttttgagaaaagaaaagatttttattgtaagttgactaacaaggagacaggaatccagctcaaacctgtctctctgcgctggctttcaagcagtcattttattaggaaaggtttagggagtgagttctgggattagcaggtgattggtggaagaagaggggaggtctggacagtccttgggcatgtgcagttatctttttatgctacctcatggagcacatgtgcaaatttggggggagttagcatgaaacatgtggcggaaattcaagctgcgattcagcaaactggttctgcacagattctagttggccatattggttccgtttgattccagccagttttgttatctcataagcagaggaaagttcagcatttcagcaagttatttcttttcttatctgttgttctgtgcaaactcaagaatttctgttagtcattgaacagagagagccgatggaaggaaattatcagagaaataactgaaatctattgaaaataattgaaatattccagaaaagaaaggcatgaatttccaaatttaaagattccaaagagtggcctacataaactctggagatatttccatctcaagtcacatctttcttttttttttttttagatggagtttcactcttgttgcccaggctggagttcaatggtgtggtcttggctcactgcaacctctgcctcccaggttcaagtgattctcctgcctcagcctcccaagtagctgggattacaggtacctgccaccacgcttggctaatttttgtatttttagtagagacagggtttcaccatgttggcaaggctggtcttgaactcctgacctcaggtgatccacctgcctcggcctcccaaagtgctgggattacatgcatgagccactgtacctgacccaagtcacatctttcagaagtatcagatcactggtgacaaagagaacatccccaagtatttgaagaaaggctccagtgtgaaagataaagacgcacactactacatgcaattttgaggaatttgggatgatgtaggaagaagatggtattagacactgcactcatgaagaaaaggacaggatgttatgaaaggggggatgatcattttaaaaaagaggctgtcagaatgaaaacagctgtaatggaacagataaaactattttccttggatatttagtggatcttgccccatggtgttggatctgccacttgagaagtctgatgccattatggtttttgacattttctatgaaagttgcttttactctctggaagcttttagcatcttttctttgtcaccagtgatctgatgcttctaaaagatgtgacttgacatggaaatatttccagagtttatgttggccactctttggaatctttggaaacaactcatgcctttcttttctggaatatttcaattattttcgatagatttcagttatttctttgataatttccttccattggctctctctgttctttatttttggaattccaattattcacttgttgtgccttcctcattggtgctcaagttctcttatatttaggccaggtgtggtggctcacatctgtaatcccagcactttgggaggttgaggcaggtggatcacctgaggtcaggagttcaagaccagtctgaccaacatgctaaaacccccatctctacaaaaaatacaaaaattagccagatgtggtggcaggcgcctgtagtcccagctactcaggagactgaggcacaagaatcgcttgaacccaggaggcggaggttgcagtgagccgagatcaccccacagcaccccagcctgggcaatagagcaagactccatctaaaaaaaaatctcttatatttcctctgctattggttacctctttagctgtttgtccttcaaagagatttccttatttctaggcgaatcctggagaagaagccccaggaagtatggactggaagactggggaggcaggccctccaagaagacagtagcatcccctgatgtggcatccaccttcctctagtgtttgagatgtgggtgcgacaagttggcattggaaggaaatccctgtctggctcttgtgctaccgtagacctggaaccctggaacaatgctcttgtctttagcccctcttctgctttcccattgttcaagccaagccttttccattttgcctctacaatggaatctaaggatagagaatgggataattggggatatgtgattgtctcctgaatctgagcctattaatatatccttctaaaggcattgttcctactgaccaccccaaagaactggattccatgagtgtccagcaagtgactaagattccaatttaggccttctcttctaagagccagtacctggataaaaggcaaaattcaacctgatagtctcttatagcagtttagggaaccacaacttgtcaggaatacaggacagcaggatttttgttaggcctcaggtaacacaccgctgcctaggccttgctgcgtcctgggatgccagaggacttgtttccttagctacaatcatcatgtgacaagaacacacagagattcggagatgttgcttagcaaccatgctgcacctgctggggctctgggccagcagcttgggccagggagcctggctttgaacttggaaactcccataagggctgtcaaaaggaggaagacctaatttggggagactgttttggccctgggcttttgcagagatggtaaaggtacagatggagaactgaggctgaggaaactggctttcccatagtaatggagaagggtggtgggcgtgggaagagcaggactagtgggcagagacagactgttgggctgatgtgggtagcagttccctgcctgacctaccctagagaaaatccttttgtctcagaggatgggtgttcagaaccctgaggagggatatgcctggctcaagaaccagttccatagggcttcttagggacctgaatcaagccagaggatctgttccctaagagtcagtccaaggagaattcccttctggaagggagcagagtgcttcacaatgggtgacattggtggtggtcagggagcgcaatgaagtagtatcagaaactgggctgttcaaccacagggccactggggagctgtccatggtttggggtaggctcctcaccagctctggctgtctctctcactctctgccagggcccagttgatttgataggctgtggagtcagattgcctagatttgaatccaacttcctctcccaggggaaagggactaaattttgtgtttcagtttatctgtctgtacaatgtggatggggatctcaaggactgttgtaaggacaaaatgagttaatcacacttcttggcatatactaaatggccagtaaaactatcatcaccctcatccccaccccaatcctcacccccagcaactggcccaggggacaaagtctatggccaggtattctccaatctttcttgatacccctggagcacatgggaataaataatggcgagaatctataccctctgcatttgcagatgggaggagcattcccctccctgcttgctgaggatttgaatatccttaaccaattgactttgttttagtgaaccaagtactcctccaacccttgatgccccaaataccctaatatcttcactttggtgctgctcatattaaaattgtacatatagcatggcactttaggaggcagtgagatcatgggttcaggacttgagctcaaatcccagcttctgttatatcctaaccacgaaatcttgaacaaattttatctcctctctgagcctcagttttctcatctctaatacagggaagtgatagtacctaaccttcttagtatgagatatgcccagctcttgataaatgttagccatgttaccaaatttctctctttgtggctttatgaactttatgaactggctccaagtgagaatgtgaggaccaagggggctagtagattccaactgttcccctaaggggagaaagggaggagttaaagaagctgatggttgaagtgcccccctcctcaatactccaacatgggactggcagctgcaatagcatctttgtcctcctgtgtttggacactgactattctgctatctggtgctgagggaatcccagccagcctgccttaagcattctccctaccctccactccagccagtccgaggtccctcaacactccccctctctctaagccatgtcaaatgctggcgcctgcccttcctcctttctcaaatgagcttgttccccagatgaccctacagctgcatggttctaagattagctggatcctgcatttgactctgataattaattacccaaatggagaaaattgaatagttaactggttcacaggaagataattagcttttctgagcccctgttacaggcaaataaagaggaggattgtttctcaattgccttcattaaagggagtccctctcacccaggagccctgacccagaggcccttgggggccctgaggggttctgtagtgctcctggtgctttatctcaaaatagagaggcagctggtacagtgtagccagcacaggcttcagactctaagcaagcttgggctcaagctccgcctctaccatgtattacctatgagaccttggtattgcagtacaacctctctaagcctccctttccttatctgaatatgggaataatgctgtgtaactcacagtggtgttataagcattaaactacataatgtcagtaacatgccctgttctgcactcattgatagattttttcattgataaagttcttcataaagtttattgttcattgatgaagtgttcattgattgggaaccattttaccatgtcatgattgtagctcccatcatagcatatgctcccatatcatggaaacaagggaaacacatatgaaagccaggagaacagcaaatcaagattaaatcgagcatcctatgctgattggtgcagggtctacacacagggtggggaagattcatgaaggtcttcttcagcctgttcaacttgtctttgtactgatattggctctgccctttgatactaggctttctgggtcaccatgtggtcactcttctgtcagcagcaatccctcaccaaccctctctcaagcacagagactcatccccacctacttgactgcagtctttctaaaattttatttactctgcccaagcccagctccctggagtgtttatcactctgacacgttcagcacatatagatacgtatgtagaggttaagagcatgggccctgagccagactgcctgagttcaaattcagcttaggtacctactctgttacttaccttgtgcctcagtttcctcattataaaatgaggttgataacaatagtacctatgtcatagaattattatgattaaataaatgtgaagtgtttggagtagtgccttgtaagtgctcacacgtgttatctattattattattcagttctgaagctggattaggacaaggagaggtctacagattgaggaaaaaaggcagggccggaggccttcacctggctagtacagggaagtgatagtacctaaccttcttagtatgggatgtgcccagctcttgatacgtgttagcaatgttaccaaatttctctctttgtggccttatgaactttatgaactggctccaagtgagaatgtgaggatcaagggggctaatagattccaactggtcccctaaggggagaaagtggggagttaaagaagctgatggttgaagtgccccagctgagtggactcagaggcaactggaccctctccgcagggacgattaactcctgggtagcaatctcacattcttttaggtaatatgttgtacttcctcatttctgcttaaaccgccaacaattcttcccatagtttcactctcagctaataactttgcatcttgtttcactgagaaaatacgggtcattagaaaagagcgtcaacaacctcccccaccacgtttacttcctgccagggctctgtccatatattcagttttcttttttttctttttcttttttttgagacagagtcttgctcagtcgcccaggctggagtgcagtggtgcaatcttggctcactgcaagctccgcctcccgggttcacaccattctcctgcctcagcctctccagtagctgggactacaggcgcctgccaccatgcccggataattttttttatttttatttttatttttagtagagatggggtttcaccatgttagccaggttggtctcgatctcctgaccttgtgatacacccgcctcagcctcccaaagtgctgggattacaggcgtgagccatcgcgcccgtcccatatattcagttttcattgttaactacctgtgttcttttccaaggccaacattttacttattgctagatcccattctttcttgcttactcaaggacactgctccagcatttttccctctctttcctgaatcatcagtttttttctctctactggaacattcacatcagcataaaaacatgctgctatttctttattgtggaaaaaaacaaaagcaaaactctttatctcacaatgattcgagctactacctcattgctttgcttccttttgtagcaaaacctattgaaagaagtcgttgttgctgtttttaacaattgctgcctccaattcttcctctcacattctttcttattttctttccttttcttttttttttagacggtgtctcactctgttgcccaggctgaagaagacctccatgactcttccccaccgtgtgtgtgggaagtgcagtggcatgatcacggctcactggctcactgtagcctcaactcccaggctcatgtgatccttgcatctcagctcttcgagtagctggaactacaaccacccaccaccatgcctggctaatttattttattttgttttattctactttattttattttatttttgtagagacaaggtctcattatgttgcccgggctcgtcttgaactcctgagctcaagtgatcctcccacctcggcctgctaaagaactaggattacaggcgtgagccaccatacctggtcctcccatcctttcttgaacccactccaatcagtctttcacatttaccactctagcaagactgaattatcaagatcaccaattgcctccatattgctaaatccatggtcaattctcagttctcatctttcttgaccacgtggtagagagaggttagctgttccaagtctcttctttctcctgggcaccagctggatcacattttccagacttatttgtagctaggtgtggtgatattgctgggttctgaccagtggaatgtgggtggaagggatttatgtaactttcaagcctgacccacaaaacctttctgtgctggaggtctgccctcctctattcacctttttccactctactcctgccttaggagcctaaccactagatactttatcaatgagccttctggtttctgactgggtcaagtcaatcagaggtatctgtaggagactgggaggaagaaggagaatgaggtcagggtacttattcccttggcttcctctctttagggttgctttgaattggccacttcctttactgaagcttcagttaggcatctcaccccacatagctcttcctctctcccaattccactaaccattattttctcttgcctcttcagacccaggggtggtaaaagctcctactgtcaatcatctctgggttatagcaaatcctttgatagctttcctgcccctgctcacacctttataagtaatctctttattaaacctttctcaaatttgagtgtgtcctctgtttcttgccagactctaaccaatgcaccatcctcatctctcacctccatttactggctggatagagtgaccttggaagccacaaattgaagataaggatcaacataagaccctgactgctgtcatggagcagagagctgctgtttccctcctttcatccttcccctctgctgctgaatatacttcacatgaatgagaaacaaagttaggttgttgacaccactgagatatggggatgtctctatttcagcatctagtttgacttgactattataacctctctgcagcatcctgggcagctgatgattctttgctcctggaaacactttctgtgcttagcatccatgacattgcattatcctggttttcttttcactccaacaactactctttcttggtcttccttgttggctcttccttatctccccatctaaatgttgaatttccccaggctcaatccttggtactcttctccatatccagttacttcctggtgacttcatccaatcctcatggctttaaacactccccagtttagatctccaacccaggcttctcccaagaacttatggctcatacatctaactgcctgcttgacatcctcttttaggtgtctagtagcatctcaaaaagaatacattgaattccagacttctttaaaacttgcttatcctgtatcttccctcaagtcagcaaatagcaattccatgcttctggttgctcaggccaaaatctttggagtcatccatgaccaatcttttggtttctcatcctgcatttaatttataagcaaattccatcagctttaacttctaaatatacttagaatctgacaagtctcaccaccacctctaccattggtgagacaagaagtaaaagataaagtgctgtaatggccaataagactctacgtgatctgattccattacttatctgacctcatcccctgctactcttcctctcactccactccagccatatggacctccttgagtttcatgaagctaccagcatactccagccccaaggtctttgcacttgcttttctcttaccctggaatgttctgatcccagatagccatgtggctcattcctttgactcctttaggtctttgctcaaatgtcaacttgtcagggaggactttcctgaccgttctatggcaaacccctttcccttataagactgtctaccccatcttcctttttttttttttatagcactgatcactatctgatgtgctgtacattttacctacttattgtctgtcccttcttgccatgagaatgtaggtgccttaattgtaaggatttctgattgtcatgctcactgcagtatctctagcacccagaacaatgtcttgcacatacaagtatttgctatataaatggatttatttctcttgaaatgttaaaagggtgtcagctgggcacggtggctcacacctgtaatcccagcactttgggaggccgaagggggcggatcacctgaggtcaggagttcgagaccagcctggccaacatggcaaaaccctgtctctactagaagtacaaaaattagccaggcatggtggcagatgcctgtaatcccacctactcagaaggctgaggcaggagaatcacttgaaccagggaggcggaagttgcggtgagcccagatcactccactgcactctagcctgggctacaagaatgagactctgtctcagaaaaaaaaaaaaaaaaaaaaaaaaaagtgtcatctgcttcccaaccttgacttacatgatttcagagctcattccaatatcgcagcctcatgaggcaccaggcttcaaggaaaagggagaaaatatatggaagcaaaaccatcctatcatatcatagtcacctttattattactgaatctcagccttgaactcattggaatgtgaagtcttctgagaaggaatctcttccccaaaccctatccaaatctgcctggttcctctctcagacacagatctacagaccagaactttcagagaacttatcctcttatcttagcagatataagactgtcagggccttctgtagggaacatacagcaaaggaatgggacaagcacagttacttttaggaccatttgaactggctttagagtggagttgaaaagcagttttgaggaagaaatctgtacccctaagcctcaaaggatggtcattggatctcatttagctttgtttcactagagcagaaactaagtttccccctaggagccccaagaacatattactcctcaggtagatattctgccaatcaaagggtggaagcagatatccctgggaactcacctgggaagcccgcatcatatagaagtcagggtagttctttactgactcctaataacgtgttttaagcagagaaattgtattattagatttgaaatctagaaaatattactttgaaacacaaaaggaaagaaaatcataacaaagcagaggtgactgtggaagctggtgtgaagaatgggttgaagagagatgagaatgaatagaaggagacccggaagttgtttgcagcaattcaaatgtgtggagagggtggatggggtgatccaaggaaaggcaatgcaagtgagaatggagaaaaatgggtgagtgaattcaagaaatggtactttattttctttctaaaaagtgaccctaatgctataactctttattttacagttctttcacagctgtctatgtcttccagggtaaagcacagtgcttagtatgactcttgctcattgccatgtgtaccataagctccagccttgctgaaaggtttttcggtatcccataagcactaggggagctcaggccctcaaatatttgcacaaaaattccccttaggcctggctgaccttatttcctaatgttcgttctgtggcttctgcccctaccattaaaatactatcactaagtttatcaatgacgttcctgttgctaaatcaaaaacatgtttttgaatccttatcttatttgatcttagctgaactcaacatttggccacttcctccttcttgaaatatatatatgtatttttcatttttatagtatgtgcttagcactattctgaaagccagggatagagtgttggcaaagtagacattattcttgcctttaagtaagatgtgatgaggtccaatcaaggatagaagtgtaggaacaccagcaattgaaggagaggaataagaaataagaaacatgggctgttattagttatcatcgtcttggaggttctagaaaatgccaaaaataaacgaaatggctaacataaatattggaaataaagagctaaacctactcctttttttctgttgttattaacaagaaaatgcaagaggtttcagtagaaaaaaaaagagtatatgaataagataatttgatgatggcttgttagaaggtaaatatacaaaaaagatccatatattttctttagtctatcaataaatacttagaagtgggatgggaaaatgtttataatagcctcaaaaactacagaatagttaagaatatatttaacaggaaaggcacaggaaaaactatataaaaactctaaagtttattgaaagacataaaagaacccaataaaaagtttaccatgttcttggatgggaaggcataatacaaaaattttatatatcaatttattgtaattccatttagaatcccataggtttttgtttgaattgaataaagtgagcttgttctatgaaggaataaatggatgataattatgaaaagaagacataggagtaatatattgtcagatttgattaatagtctgggaaaagcaaattgaggtaacaccactttatgtccaccagactgcaaaaaagtaaaaaggagctattgcgggtggggatgtagcaaagtgtctctcatacattgccaatggaaatctaagtgatgcaggctttctggaaagcctagtaatagctattaaaatttaaaattaatatatccttcacccagctagcctactcttaggattctatctcttagaaacaagagcaccagtatgcaaggatgtagatgtattgcttgttaattgtgaaggggaaaaaaaaacccagaaagaaagctaatgcccactaatgggagaataagggcatacattttgatactttttttgaagccatcaaaaaacatgaattacgctgggtgtggtggctcacacctgtaatcccagcaatttgggaggccgaggcgggtggatcacctgaggtccggagttcgagaccatcctggccaacatggtgaaactccatctctactaaaaatacaaaaattagccgggcgtggtggcaggtgcctgtaatcccagctacttgggaggctgagggaggagaactgcttgaacccaggaggtggaggttgcagtgagccgagatcttgccattgcactctagcctaggcgacagagtgagactccatctcaaaacaaacaaaaaatgaaaaccatgaattagagctataccaatgaacatggataatatttcacaatgtattgactgagaaaaaacaagatgaagaaaggttttttttttctcccagaaaacaatgacagaaaactgtataaaacttatgtgtgtgtacgtttgtttgtataggtctgaaaataattatataagcatggggggaaatacgaagggttattttaatagtattagattcacctatgagcaaagaaagcccaaaataacaatggctcaaataagatacgtagttcatttctctctcatgttaagctccgtgttaatctggagctgatgtggtttctctctttcatgaaaatctctggaacccaggctccttccagctttctgctctgccattactagaatgtgaacatcttgaaagtccagcctgcacagtttcatcctcagacttcacgttccatgtagcaggttagagaaagaggaaggagaaagggtatatgtaaattgtctcttaaagatttctggatgcgcaacaaaatgctcccattggtcagaacttagtcacatgaacacatctagctgcaaaggagaatgggaaatgtagtctttattctgtgtggctatgatcccacccaaaaatttcgtgacgctttgcacgcatgcattcttgtagacaacttaagaatcagtctttcaagttccaaaaataatcccctgggtagtttgactgcaactgtattaaatccataaagtgattcagggaaagctaacatatttataccatgtaatgtggtatacctctccaactttttatcttgtttggaatattttagaattttcttcatgtaagttttctgtatttctggtcatagttacacacagttatttacagttattgttgcaattatgaatggaagttctttttagtacaatttactaagtggctatttttggaatataagaaagtcatagatttatatttcttgtattgaaccaatttattgacctttcttattaatttcagtaatattttctgttgggtttcatggattttctaagaagaaaagactgtagcctgaaaatacaaataatttgctgtttcttttaatatgtatttcctttgtttttttcttacctaatggcactgttctgagactccagaaacattttgattaatggcaataatagtgagcatcccatttaatagaaacgcctccagtatttgtttaatgttttaccattaagtttgctgcttgtggcttctgattttaaaaagtgtccctgggccctctgttctttgcttagtaaggtgtttatcattatttttgtcatcactgtcattattatcatcatctgaaatggaggttatactctaattaatgcatttgggcatatattgagatgatcatatggtttttttcctttcactatctgatgtattacaggatgcttagttcaacaaagatttcttaatgttgaaccaatcattcttcctgaaataaacactacttggtcatggtacataactcttttaatatactgcttggtatgacttactaatattttatttaagactttcataccagcaagtgcttggttagatttttgcattataaaatgaaattggatcttttttgatgctagtttaaatatctagtttaaacaacatacaaatggtatttttaataagatttcctagaacctactcataaaaccatctggggcagaattacctaggggcatagattatttacattttcagttttatcaatggattttagtataggttccttttgttttgttttagtttttagaggtatgtacttgctctgttactcaggctggggtacaggggcactatgatagctcactgtagcctcaaactcctgggctcaagggatcttcctggcccagcctcccaagcacctaggactgcaggtgcttgccattatgcccggctgattttttaaaacatgttttgtagagacagggtctctttgtgttacccaggctggtcttgaactcctggcttcaagagatcctgccacctcggcctcccaaattgctgggattacaggcatgagctactgcatctagcctatataggtttcttagaatcaattttaggagcttatatttttatgggataccattcattttaggtaaatgttcaggtatattaacatcaattttaacataaaattttcaaatagcttaattattcttaatatgtggagataaagaccctactcctgagccctggcattgtgttacttgtgatttatttcttaatttttgcttatgcttaacagtagtttttccttttcttcttcattttcgtctttttaaagaagaagcttagttttatttatcaagtctggttattttgacatcttagcttttatctttaataattcctttctcctaaaatatcgatggtctaccctcatacttattgatagctttgctaagagaattctagttcaaatttttttacaaagaaataaaaaagtcattgctctattataataagaaatgagataaaattgttcatatcaacaatgtgttacatacccagcgctgttgagtgtgtgagtaaaagccactttcagacaccactactgagaatgcatgttggtacaaccatctggcaggcaatttgacaatatgtatgaacacttaaaatgggtatacatttgaacaaaaaattgtacttctagcaatttacacttgggaaattaactagatcagcaaacaaagatgtatttacaaggatagcctttagagtattatttctagtggttaaaattgggagatggattgaataaatgatggcatagccatataataaaatactacacagtcatgaaaaagaatgtgataggtgatgttttaagttgatatcaaacagctggttaaaccacagaaaatatgattccatttatgtaattatattacatataatctggaagtgtgaagtgtggctatttctggagacaggcagtagatctttaacattcaccattttgtgtcattctttcaataaatatgccttatcagaaaaaaataattttcaggaaagaattccagctgcttacacattctggattatataccataaggatttattacatgctatgctgggtagcagaagcgatgaggaaagggagggttagtagggttctacacttggatggtgaagagaaggtaatgtttttgcctagagaacgtagaggattgatgaaagtttcttccccctcaccaggtagtagacacttcaagagataggggaggagtcccctggaaaccgaacaagggctgggtgtcgtggctcacacctgtaatcccagcactttgggaggaagaggcaggtggatcatgaggtccggagttggagaccagcctggcctaaatggcgaaaccctgtctgtactaaaaatacaaaaattagccgggtgtggtggcgcatgcctgtagtcccagctactcaggaggctgaggcaggagaatcccctgaacctgggaggcagaggttgcagtgagccaagattgcacgctgtactccagcctgagcgacagcgtgaaactgtgtctcaaacaaaacaaaacaaaacaaaacaaaaccataaaaaaccaaaaacaaaaaaaaccaacaaggaggcaggactcttactgtgccccaagttgtctagaccttttgggtttcctccaaccctgagatcctgcctcagcttgcttgctacgtgtcctcaacatctgtcacaagtgtcctaagcttctgccctttgagtcacccacaattcctaaatgtaccttgcatctttgtatctgtctgcttttcctgatgtggtccttcctaaggaacagaatattccacttctctagagaagaacaaataccccttggttcttcaagatctggttcatggtagattagattattattcagcaaatattcactgtttctcactacatatccatggaggaatgttcttcctttcatcttgactttgagcttctccatgtgacttactttggccaatgggatgttagtacacatgatgtgagcaaaggcttaaaatgtgcttgcatgttgggcttagtctcttgcatgcctattttttgccatgatgaccaggtagccacaggtacaaggaggccccaaatgcatggaacagacttgagccaaatacatggcctggagtgcagcctgtataagcctagacaaagtcagagtcaatgcatagcaaacctccagtcacctggatgagaaacttacaaatatgtattgttcaacactgaggttgctgcagtgtttgttatgcagcagtagctgccagatgcatagctttcaaggtctcttgccctttattctctgagttctcccccccaaatcccacctatagtacaactgcttaaaagctgttattatactatattatgattatctgattgatgtgcttgtatcccacattagattatgaacttccaagtggacgtaaatgttctgggagaactttgaggagctaaaaaacacctgccttgacacttgtcttacagctaaaaattgtgattattgagcaagttacaccaagatctgtgagcatatattgcagcaagtgaaaaacataatgcttgttttcatgttgtctttgggtaataaagaggggccagtccattcaacctatcttaaatgaggtaaaagaatatgggtgggcaccatggcccacgaattctaccctaggagaggagtaaaagaggcccagacacctcctttctttgaagcagtgaagtgttctaaaaattacaggacatctgaagctgtttagatattttaaaaaaggagaagtctcaaccaacagagactgaaggcggtgtaggtgagtgttcaacgttgcttggtactgtctgggtaaagaacaaatgggtggtggaatgatctttgatcacattctgtctcatagtacttaaaaacttccattttatttttgattttaaaaataccaaatactaaaattgagcccataaaaaggacggagtcgcccatgattctggaaaggctctaaatcgccaaggtgtggtccaaggtcattactaggcttggcacatgtgttgatgaacaaattgagagatacattaatattgaagtttgcagaaaggggattaggtccttaagaaaccacttgatctgcagagatattcagaatgtgaatgtcttcagggaccctggaaaaacacatgaccccattttaaatctgaaattgtatgatctcaaagaagtccagttacatgtatgacattgctgtaaaaagtgtttttccaaatatacctgcaataagtcttaaaaatgtctgtaccctttgacttaacaatgccatatctagggagtacagcagcctgaaggaattaatcagatatgtagatagagatctaaagtaatgttgattacacggttatttataatagcagaaaacagtgaacgtgttagtacaaactatattgagaaacgtgagtttctgtgggcactgccaaatttgctgtgtcatctgtcttcagagacatagaccaatttaatttaaagaggccaggactgggagaagggataggcagagggaaaggaagatgtggtgagagacagaggaaggaagggacaaggagggaggcaggaatggagtcagggagagatggagaaagaaacaaaaacagagacagggacagagactgttgagtggtatgtgatgaatcaatgtctgtgcaataaagattcaaaagggagaaagagtcagagacaagagtggattcaaaggcaggtcccccactccctgttttcgttagaactcaccggccctggagcacccactgttaggacccaggccacacggaggggacagctagcagcagggctgtggagtgggagggcaggcaggagcagggctatcagcacaggctgctgagtcaccagtggtcggggagaagggaggaagtcccaggctatgctggctctgttatgggctgggggagcagggaaggggctcaggtcataggtagggggaaggatgctggatgctgtgttctaagccccgaattatggcattatgggtgtggaattcactttctaattgcattacccaccttccattaactcctgtgtttgctgtgggatcctgttaatggataatcattaggaaatcctgttttagggttatagatgcctttggatagtttcttaggatgatttgagaacttacccctcagtaattatttcaagttgattatttgcatgcataatccagatctcaggggacatattttattcttttcaacctcttggtggattggtgtgtgaggggggtgggagtgggtgggtgtggcatgctcatggtggataatgtccttcggtggctcagagtttctgctgccacggactgagttcagttcggtggctcagagtttctgctgccacggactgagttcagttggaggattgctttgcttttccatcccgctcttctgttctgcactgcagcatcccaagcagccttttcattggatacccttgccccaaacctcacacccacacagtctgtgtgagcagcagccttgctgaaggctcggtgcaacagacagctttcacaccctgcccagcccttctccaccacacactcccagctccctcctctccttaccactccaggttcccttcagaggcccagttctctgccttgaatttaaagaagcagttgaagtctccatcctttcctcacctcggagtctaccttgttacactcacagcatccttaacgtgactgataaacaaagggctacctggtttttcaattttttagtagcaatgaaccagcaaggactctgaaataggaggctgtcttaggttgagtttttggaagcagactctgagaagaggattcctataaaaattatttatttaagaagtgttcctagaaaaaaccagttgggagtgggcgggaaagtgggaccaggagagaaagaaggccaggcaaaggaacggcagcaggcagagtccggggagggctgctttggctcagtctctcctgggaactcagcagacaccttccagttacccccaccagggagcaagagctggaggattgtattcgtatgtttgtcagtcacttgttaagggctgtcccaggggtatgttaatttccaggctcttcaccaagagatgcaggtgcaggctgttgggtgtgaaggcgcatgggaagctggtggacacagtaaatggtccagggatctaaaggggctatgggcgaggcaccaacagtgtctgccgtaagtctttccttcttccctcccttactcaacttcatgagtggaaagacagttgtgtgaacaatttcctcactgatgtgggttctgccactctgtagaaaacaaaagcagcttggtcaggtgaggtggcgcacatctgtaatcccagcactctgtggggctgaggtgggaggattgcttgatgcgaggagttcaagacaagcctgagcaacatagggagagcccatctctacaaaaagtagaaaaaaaaaataaattatcctggtgttgtggtgagcacctgtggtcctagctacttgggaggctgtggcaggaggattgcttgagtccaggaggtggaggctgcattgagctacgatagtgctactgcactccagcctggaaaagagagagacctgtctctaaaaaaaaaaaaaagcaacagctatactggagctggcttgcttactcaggaggacaagagctactccaggcccttctcccattttctgactcctgtctggcatgacttatctctcaggatgactgcagcttgggcatcagaagaaaggggtgagcattcacatcaaatcaggggtccgttcctcagaaattccacgtggagttgctcagctccccttctagatgggggcttctctggttatctctgagaaaatgccccaaccccacgtcacagagccctgggtgcacaggagctaccacactgtcctcattcagaacctgccctatctgccctgagtttgctagatgcaagggagcaggcaacttatcctgtttgagacacagctctcctgtttggggctctctgccccacactggaagcaaggtagcgggtgtagtcattaaccaagtcctgcccttttggggatccctctgactggggatgggaaatctgctgttttcctccttcaggaactcaacctcaggtcctggagtcatgtccaccttgactccgggagtccgagctggggctgctattgtgaactctgctatgctgggctatttctcaatagcactcaagattgcctccctctccttcttccccagccttaactccagtaatgagggaatgatgtgggagaggtttatccagatcttggcaatcaatgcttttccaatagacttttgcttgctctgagctggattctctttccccagttcaacagcaccttccttagctgctttttgtgaaagtgtcactggtcagaacacacatgcagacaattcctcttgacttgccacataactgaatattgactgtgtcaggcagtcggccagtggtatggaggcccctgaaaaccagaggctgctgcagacatcgagtgaggcccacagactgcctgcagtttcttatgcttctcccctcaggtagttgcccaccttctaacatctctgcctcatgggtagcgacattaaaaacatatgcctttatatcttctttctctcaaagcctcaaaatgacagtggagaaatgataacaaataaaaccataaatgtataaggacaaagagttttagagaggatatagaaatagatcatgaatgtcaagaaaattttggaaggtgatcaattaagtcagtggtaatttacttagaagagcagagaaagttaaaatttaaacctaaaaaggggggtggtacccagtgaaaagaagctagaagattttttactgaagtatccctattgaaatatccctgaagatggggatgagtgtgatggaccagttaaaaaggaattatttaggcagatagtaagggtaaggaagtcctcggtaagcttttccttttaatgaaaagcagcctccaaatcattttcttttctaacaaagagcagccagtaaaatcaagctgcagacatagaaaggcaggctagaagcttgcatgggtgaatgctggccattgtggcaataggaaaggggctacctggggaccaggtatgttcaaaatgatgactccatcttcccttttgcttgccaaccacgtgtgcagtcgggagcagacaacatggccccgggcagacaaagactccatttgcataaagaagattagggtggggtggccggcttccccacatgcgatataaacatcacacttggtccaaccaaccttagggccctttctaaatcagacaccgcttcctcaagcctgcctatgaaaccctgtgcactccgccgcaggccagaagttccgcttgggcgcctctctctcttgcagaagagagagctattttcctgtctctttcttttgcctattaaaccttcacttttttttttcttttttgagacggagtcttgctctgtcgcccaggctggagtgcagtgacgccatctctgctcactgcaagctccgcctcccgcccggctaatttttttgtatttttagtagagacgggttttcaccgtgttagccagcatggtctcgatctcctgacctcgtgatctccccgcctcagcctctcaaagtgctgggattacaggcgtgagccactgcgcccggccgctaaaccttcactcttaaactcactccttgtgtgtgtccgtgtcctttatttccttggcatggggcaatgaacctcgggtattaccccagacaatgacaaagcttcaaggggtggggctgaaaaatagaagagacatcttggctatctgtttgaggaagcagtgaggctcccagatgtctaccccatttctacacaagccaggcaactatcccccctatagctggaggggatgggacgttcaaatgaggagatgctggcgtttggggatgtcaggtgcagttgagaacagggaactatactgaaaatgggcactaaatggacacctacctgtggatggcaaaacctccaactcgccttccctgctcagcagccagcatgatggcagagcttatagcctccaggaagaagaatggaagattcctctggggatactgactaggccaagagaaaagacctactaacataggtttctccagtgaaacagctgggtccccacctgatcagcctactgtgaagtccactggcagatgagcctcacccatacacacagaactcgaaattagcattttggtccctttactattatgtctgagtaggtagattagcatcacttgacatcagaggggagctttaacatgaaagacagaggcataaatgaaccaaccacccaaccagccacagtagaggaaaacagactgcagaaagcaaaatgaaatttcaagaaaatcctaaaccttgtaagtctggtatctatgaaaactatgaaatagtaagctatacaaaggaatatatagctgggcatggtggctcatgcctgtaatgccagcactttgggaggccgaggcaggcggatcacctgaggtcaggagtttgcgaccagcctgaccaacatggagaaaccccgtctctactaaaaatacaaaattagccggacggtggcgcatgctggtaatcctagctgcttgggaggctgaggcaggagaatcgcttgaacctgggaagcaaaggttgtggtgagccgaggtcgtgcaactgcactccagcctgggcatcaggagcgagactctgtctcacacacacacaaaaaggaatatccaaagaataaaagctcttgaaaattcaaaataccatctattgggtaatatgctcacaacatgggtgacaggatcatctgtaacccaaaccccagcatcatacaatatacccatgtaataaacctgcatatgaaccccatgaatccaaaataaatgttgaaaaaaaggaaaattcaaaatatgatagcagaaatcttaaaaaatcaacggatgaattaaaatataatttgaggaattctctgagatagtagaagaaaaatataaagaaacagaaaatgaaaagaaagaaaaggtaagaaaattcaaggcttagaccagaagatctaataactaagtttcacaaagaagagagaaaacgagggaaagaaatgatcacatttgtagacaagatagaatttttaaagagggaataacctagtgcctgttgttgggaaaatacataactaaattgtggtatcttcacacagcagactgctacgctgcaataaaaaggtagtgaaccaggtgtataggtaattcttaggaacaatgctgaatgaaaggcaaaccatggaagagtgctctctctgtgcaatgccatttctatgacgttcaaaatcaagcaaaagtaagtgaggtatagattagcaatgcatacatatttagtgaagcaataaaaggaagcaagataattggggaaaaagtcatgagggtgattatgtagctggtagggggcgaggcatggcaggcaagggagaagatggaatgagattaggaaaagtcagtacacaatggttcaaggcattggtcatgttccatctcctaagttgggtgctaggttcttgggaatttgttttactatgtttcataacttaaattacctgtatgttaagtctctctctctctctctcgctctcgctctttctctctctctctctctttcacacacacacacacacacatcccaaataatataataaagtctccctgaattaaggatgtgagttttcagattaaaagggcctaacagtccagtgcaatgagggagaaaatactactccaaagcatatgtgaaatttcagagcatcagagataaagactatcataacagcaggaaaaatagctcacatacaaaaactaagaatcagaattgcgttggtgttctcattagcaagactggaaatggaagacaatagcccttctaagattctgaaggaacaaggttactacctagaattctagactcgacaaagtaatatatgagagagcagaagtaagacacactcagacaagttagacctcaaaaattttatcttccacctaccctttctcaaaatgagaaaatgtactccaccaaaaagagccagtaaatagaggaaatcatggaaaccatggaaacacagattccaatacaggaaagaaacaaaaagaatataaagaatgttagtccaaggaagtccccccaaaactgctggaagtaggcatagagcacaagagatccaggttggagaaaaacaacaagagatctccaggagagatttctccatgaaaaacatgcacgtggtcagtttcctaatatttcagtgtactgagacaagatttacagttttgtgtggcagttttaagaaactaagccccaaacaaacaaacaaagcaagagagaaaagaaaagaaaaaggaggctatttattaagtccgaaagttgtgcaggaaaggatatataaatatatcatgtggctcgatagcatgtaatagttatgtaattctgataatgtgaaatattgactgaaacagaaactataatatatatgggaaaataaaggcaagtggaagtatgtttacaggaatttctaaagtgaaaagaatcaaccaaaatagaagtacaggctatataactctgaaccaaaactagatgagcacaatagaagacaggtaattacagccactttcactcatcagcacagacacaacagttctaaagaaaatgttagcaagctgaatatggcagaatcaagctggtcttactttagtaatgcaaaatcaatccaacttaaaaataatgtattaatataaatcatcacaatatagactaaaggagaaaatctacatgattatcttgataggcacggaacaaatatttgatgaaacttagcagttaagttaaaaacaatcttagccaactagaagtaggaaatttctttaacttgatgaaaaccctctaataatttacatcagatagaatgcataataataaagttttaaaaggattcactttgaaatcgggaagatgacaaaggtgtcctctaatacctttctatccaacattgtatttggagagcctagccagtgaagacaagaaaaagaaataaaactgcgtcacccttaaaagaacctttctgagaacattgggcccacctggataatccagaaacctctctgcaccttaagatccttaatatagtcacatatacaaagtccattttgtcatgtaaagtaccatagtcacagatttgggggattgggacatgaacatttttggggggctgttattttgcctattgcatatgactcacatcacttccatgtaattattcacaggttatatgattgtttacatagagaaagccaagataattgacaaaaaggcttttagaatcaataggagagtttagcaaattgattcaattgttttcaagcagttcagacacagaaaatacaattttaaaaaagatgtcatttataacgtcaagaaagaaaggataaagtaccttgcaataaagctaacaaaagaggtttaaaacctttatgaaaaaattctagaaagtgatgaaaaaatcttaagtataacctattaaataaacagaaaaacatattatgaacgtggacataaaaatgtaatatcataaagatgtcaattctccacaggaatatatagattttattgcagttctctttttattttattttattattttttttgagacagagtctcgctctgtcacccaggccggagtgcagtggcacgatctcggctcaccacaacctcctcctcccaggttcaagtgattctcctgcttcagtctcccgagtagctaggactacaggcgctccaccacgcccagctaattttttgtattttagtagagatggggtttcatcatgtttggccagctggtctcgaactcctgagctcaggcaatctgcccacctcagcctcccaaagtgctaggattacaggtgtgagccactgtgcccagccgactttactgcagttctaatcaacattctaacatttctttggaacttaagctgattctaaaatgtaaatagaaatgtataagaacagataagacacagtgagaagtagaaaatgggtggactcaccctaggatacaacaagacatatcaagtatggtaattaaggcagtatgggcctggcatcatggctcacgcctgtaattccagcactttgggaggctgaggcaggcagctcacctgaggctgggagttcgaaaccagcctgaccaacatggagaaaccccatctctactgaaaatacaaaattagctgggcttggaggcgcatgcctgtaatcccagctactcaggaggctgaggcaggagactcacttgaacccgggaggccaaagttgtggtgagctgagatcgtgccattgcactccagcctgggcaacaagagcgaaacactgtctcaaaaaaaataaataaataaataaaagaaaaaaagaaaaataaaagggtgccattgaaacaaagatatgtaactggaccatcagaacagaatacagagcccaaaaacacacccatagattgatatctgatataaatgacacagcaacattgcaggtaagtggagaaaagataggcttttcaaaaagtgatgagtaattagttactcatatagaaaaaataaaacaaaattggaattctcagaccaaataaaattccaagtggaattcaggaacctagttagaaaacttttagaatgtgggaatatatctacgctcttaggttaaagatttactaaaatacaaaaaacacaactcataaagaaaaaggttgatagttaacatcaatgaaattagaaacacctgagttctgaaaaccatcattaacgtggtgaaaaggtgatgggcatggtggctcatgcctgtaatcccagcagtttgggaggctgaggtgagaggattgcttgaggccaggagttcgagaccagcctgagaaacatagtgagactccatctttacaaaaaaaaaaaaaaaaaaaaaagaagaagaaagaaatatctaactccagattgggggaaaatgtttgcaatatacataattgacaaaggatttgaatccagaacatataaataactcataaatcgataatttaaaaaaaactggaaaatgggtaaaagtcaaacaggtaaatcttagaataagaaaccaaaatggacaataaatatatgaaaagataatctcatgaagaatcagagaagcgcacactaagccacaataaaataccattttaaatccatccaattgggaaaatggaaaagtctgacaatttcagatgttggtagccagatggagcaatgggaactctcatacactgcagaagtaagtgtaaattggcaagagcactttggagactcagcaagcaatatctaaagctcaaggtgcttatgtcctgcaactcagcactaccattcctaacatgtacaagaggagacatttgcaagaaagttcattgtaacattgtttgtaacaataaaaaaagagaaaaatcacccaaatgtccaccaacaggcaaatgggtacatacattgtggtatattcatataatgagacaaaaagaaattaatgaaccaacaaaagaaattaatgtacaacaaaagaaattaatgaaccacagctagatgtgtcattatgaattactgtcaaaaacataatgttaagttaaaaaaacaagtttcagaaagtatttaccatttttataaaacttaaaaacatgaaaagtaatatatattttacaatagagacatatatctattaggctggtgcttttttgtttttcgagataagagtctcgctctgtcacccaggctggagtacagtggtgcgatctcggctcactgcaacctccaccacccgggttcaagcgattctcctgcctcagcctcccgagtagctgggattacaggcatgcaccaccacacccggctaatttttgtatttttagtagaggcggggtttcgctatgttggccaggctggtctcaaactcccgacctcaggcaatctgcctgcctcggccctgcaaagtgttgggactacaggcgtgagccactgcgcctggcccgaaaactgcaattacctttgcagcaacctaatagcaaaagtataaaaatatgtataggaataacaaataccaaattcaggatgtggttcccttttggcaggaaggaatgaactcaaggagggtaacacagagctaaaactgtagatttaatgctttatttcttaagttgggtgatgggtatcattattatttggactatttgtataattatttgtattatgtggaatgacatatgtcactgaagtagcatcatatgcttattcagaaacatagaaggaaaggaagcaggaattgggagttgggaagtgaaagaaaatataggggattcctgtttttttaaatcttgccctcctggttgaccttttaaactatatattgttactacttcaaaatagtcaatatcgtcaaaataatgaaaatttgagccagagagtaatatatgatatgcttctggaagatctccattttttgttattatactttaagttctagggtatatgtgcacatcgtgcaggtttgttacatatgtatacatgtgccatgttggtgtgctgcacccattaactcgtcatttacattaggtatatctcctaatgctatccctcctccctccccccaccccacaacaggccctggtgtgtgatgttccccttcctgtgtccaagggttctcattgttcaattcccacctatgagtgagaacatgcggcgtttggttttttgtccctgcaatagtttgctgagaatgatggtttccagcttcatccgtgtccctacaaaagacatgaactcatccttttttatggctacatagtgttccatggtgtatatgtgccacattttcttaatccagtctatcattgttggacatttgggttggttccaagtctttgctattgtgaatagtgccacaataaacatacgtgtgcatatgtctttatagcagcatgatttacaatcctttgggtatatacccagtaatgggatggctgggtcaaatggtatttctagttctagatccttgaggaatcgccacactgtcttccacaatggttgaaccagtttacagtcccaccaacactgtaaaagtgttcctatttctccacatcctctccagcacctgttgtttcctgactttttaatgattgctattctaactgatgtgagatggtatctcattgtggttttgatttgaatttctctgatggccagtgatgatgaacattttttcatgtgtcttttggctgcataaatgtcttcttttgaaagtgtctgttcatatcctttgcccacttgttgatggggttgtttgtttttttcttgtaaattggtttgagttctttgtagattctggatattagccctttgtcagatgggtagattgcaaaaattttctcccattctgtaggttgcctgttcactgtgatggttgtttcttttgctgtgcagaagctctttagtttaattacttcccatttgtcaattttggcttttgttgccattgcttttggtgttttagacatgaagttcttgcccatgcctatgtcctgcatggtattgcctagattttcttctagggtttttatggttttaggtctaacatttaagtctttaatccttcttgaattaatttttgtataaggtgtaaagaaaggatccagtttcagctttctacatatggctagccagttttcccagcaccatttattaaatagggaatcctttccccatttcttgtttttgtcaggtttgtcaaagatcagatagttgtagatgtgtggtattatttctgagggctctgttctgttccattggtctatatctctgttttggtaccagtaccatgctgttttggttactgtaggcttgtagtatagtttgcagtcaggtagcgtgatgcctccagctttgttcttttggcttaggattgacttggcaatgcggactcttttttggttccatatgaactttaaagtagttttttttccaagtctgtgaggaaagtcattggtagcttgatggggatggcattgaatctataaattaccttgggcagtatggccattttcacaatattgattcttcctacccatgagcatggaatgttcttccatttgtttgtgtcctcttttatttcgttgagcagtggtttgtagttctccttgaagaggtccttcacatcccttgtaagttggattcctaggtattttattctctttgaagcaattgtgaatgggagttcactcatgatttggctctgtttgtctgttattggtgtacaagaatgcttgtgatttttgcacattgattttgtatcctgagactttgctgaagttgcttatcagcttaaggagattttgggctgagatgatggggttttctaaatatacaatcatgtcatctgcaaacagggacaatttgacttccttttttcctaattgaataccctttatttctttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcataaatagctcttagtattttgagatatgtcccatcaatacctaatttattgagagtttttagcatgaagggctgttgaattttgtcaaaggccttttctgcatctattgagataatcatgtggtttttgtctttggttctgtttatatgacggattacgtttattgatttgcgtatgttgaaccagccttgcatcccagggatgaagcccacttgatcacagtggataagctttttgatgtgctgctggattcggtttgccaatattttattgaggatttttgcatcgatgttcatcagggatattggtctaaaattctctttttttgttgtgtctctgccaggctttggtatcacgatgatgctggcctcataaaatgagttagggaagattccctctttttctattgattggaagacagagtcttgctctgttgcccaggctggagtgcagtggcacgatctccgctcactgcaatctccacctcctgggttcacaccattctcctgcctcagcctcccacgtagctgggactacaggcacccaccaccatgcctggctaatttttttgtatttttagtagagacggggtttcactgtgttagccaggatggtcttgatctcctgaccttgttatctgcccacctcggcctctgagtgtgctgggattacaggcgtgagccaccgcgcctggcctggaaaatctccatttttatgactttttcatttttaattttttttaagagacagggtatctgccaggcacagtggctcatgcctgtaattccagcagtttggcaggccgaggcgggtggatagcttaagctcaggagttcgagatcagcctgggcaacatggtgaaaccctgtctctacaaaaaaaatacaaaaattagaccggtgtggtggcaggcacctgtaatcccagtacttgggaggctgaggcaggagaatcacttgaacccaggagatggaggttgcagtgagccgagatcacaccactgaactccagcctgagtgacagagcgagaccctgtctcaaaacaaaacaaaacaaaaagagacagagtcttgctctgacgcccaggctggagtacagtggtgttatcatagctcactgcagcctatactcctggggtcaagagatcctcctgcctcagcctcctgagtagctgagactaggagggtgagccactgtgctgggctaagatctccatttttagatgctttatctcagtgtattcaaaatatggtccttggacaagtgtgggttggtgatctggtctgccatcaactaaatagagaactgagcctaagtgtttgggaacttttactgcaattttagagtgattttatttatgctgaatcaataatttaaaaagtgagacttgtattttgtattctataatttactgtattatcatttttttctagaaacaaactcttatttctcaaaagtattggttgaaacaaattaaaatgaacaaaaaaccaactggttttgcacaagtagtttgagatatattgctctatcttactcaaaattgatgtgtatgtgatttctttttctataatgtgaagttttttttttttgttttcttctttggggatcttgtgatctactcctaaaatattaatgtcatgtgggattccagaattgttttgttttgttccagatatttgccttgcatatataaagaagatgtggccattctttgcatgctgtttccccagagacacatgtaaatggagttgtaatttcctgttggtaaacagcaagtatttaaatttagaatcaggtggtaaggttgatatgtagacgggtaataaattgaattgccttcaaagcgataccttttccagttaactgttaactcaccagtttactgcttttcttttctttcttttttatgcttcatgaatttgtgtgtcatctttgtacaggagccatgtgctaatctctgcactgttccaattttagtgtttgtgctgctaaagcaagcacggcttttcttaatcgtatcaaatattacatggtatgtgaaaacagtatatatctggcttgaggtatttcactgatgacaaatggacctcatgttatagaggaatgaaagatataaattaataaaacatgatcatgataagaataaaaccaaactaaatctcctctccagtgcttggcagcacactcccggagagggttcaggctgtgcgtggccccccagcggtgctcagagatggcttaatggcctcggtgacaacaggagcccagactgcataagattctgcctctgcagatgcagaacagtaggggcctctgatgtgctcaaacatctgttttggatctccatttctcctcaagaagagactactttttaaaaattatttttttgaagctggattacttactgatttccagagtcctcttacacctgccacttctcaagggaatcctttgggcataatcttttaatctttctggaaagctaacaaaacattacctgtgccaggccttccaccaggaacaccccattctttccatcatagtgctttttaaaggactttatcatttgttctctgggttcatttaactcttaacttacaccaatttagcatctttgctgtatttccttgctatttcttatttcattctttacatgttatgttacatttctgtttgagtctttacagtatcttctttcttaccaacttgtctttctagaatattctcacaattaatgttttggtttgttttgaggtaggcgatcagcaggacttgttttctgagcactggtcaggaccctgtctatctaaatggtaggtagcaaagaaactgcccaaagccaggtaggaccagcaattataatgcacttgcataagacacttctatcagtaccatgacagtttacaaatgccatggcaatgacctggaagttatcttatataattctgggaactctcttccctttttccgtaaagtttgtgaataacccaccccttatttagcaaataattaagaatgggtataaatataggtagccagcaatccacaagtgctactccagaccagtctgtctatgggatggccctgctctgtctatgaagcagtcacttggctgtacactgttgctcaaataaacttgctttctttcattgtcagctcactcttgaattccttcctgggtgaagccaaggatcctcctgagctgagccccaatttcgggatttgcctgtatcagcctggtgacccagatgggacaaacaatgggaacaagatgaatgggacaaagtgactcagtacagatcggagttgtggagctgtaacactatgaagctgtaactctagggcagtttgcgctgtagagctgcgcctaaaggactcttttcagagccatcatctttcctggcaactcacaagacaagggaacctgagggaaaccttcacccaaaccccaaataaagacagattagcaccatttgacttccacacacaaaggtcagtcttccctttgttccccctcaatattgacctttttgggtgagccaggaaatgggaactgagtctctggcttggtagctcattgtcccccatcatctgagtgtcccgaatggcagcaggcctggcatgtccttgtcaccctttctcctggaccttcctttttctctttagtggctaatgaccgccattttacttttacacttattttgttgttgcatttgtggtctttcctttagatatttgggcaattgtttctgttcaatgtaaggcaagacactttccgtgtttgtttttaaccccttcttttctaattttgagaggtcccctgttgtcctgactctgggatgcctgactctggtgttgaagccctagactcaagcgatctgcgcgtcctggcctttcaaagtgctaggattacaggtgtgagccactgtgctcagccatgtgcctttttctttgtctgatttgactttacgcaaggagaaatttggttggttttcagaggatccaggaaagtttacggagaaatttgttcagttgatcgtgttctttgacttaacatggcatgacttgcaaatattattgtctacctgctgtactgcagaggagaaacaaaggattctgggtactgctcatgaatatgcaaatggagtggcaactggtaactaaggtcatgccatttatcatgtgaggggagatgcagctctagatctggtccctcagtgggattaccagaggggttcccaagatcttgaacacagaaatcacatggtaacttgtttaacagtaggtatggaaaagtgtgtggttaagctagttaattacaacaaggttagagaagtaactccgaggaaggacaaaaatctcactctatttcaggacagtttggttgaggcaagcaggaaatatgctaagtgtagacccaaactccctggaagggtgagctctcctaggtatgcatttaattacttaatatgcccctggcattatgaggaagttacaaaaggcagaaatgggacctcaaactcccatgagtcaactcttgtacatggccattgggtttacaacaacagggacagagcagaggaagcagagaaaaccaaaataaaaagccaaaaagcccagttgttagtggctgccttaagccacctgctgcctcgaggttattcatcccagggaagtgttgcaagatcggtgtctgggctgcccagacgatagcccccaacttgctggcccctgagccagaatcagtgtgcctaccataagcaagagggccattggaaaagggactgcctcaggctccaaggggaatctgggccactcaaacccataatggccaagacaacagagaactgacgggacctgaggttccccatggctcccactggacaccttaccatctccacagaggagccgtgggtaactcttgatgtggcaggtaagaatactgagttcttattggatatgggagcagccttctcagttctgacccatttctcagggccactgtcttcctactcttgtaccatactggtggtacaagagtaccaccttatacaaggtacatgattgatagccagccaaaaattaggagattcacccatccccttggttgcactgtaggcgatcatatgttttcccacatgttctagcttatgtctcagtgcagtattcctttactgggaagagacttacttttccaattacaggccacagttcaatttggagagccccacaaaaaggcaataggccgggaaggggcactacttctagctctaagtgcttgacttactacaggtaaagaaaagaccttccttccaccgcatattacttctcaagtagactcttctgtctgggacaaagaagttcctgatagagctgttaatgttttacccatgggaaaaacaatatcctttgagacctgaagcaaaagcagggatacagccccagatagaaaagtttctaaagtaaggattattacaaccctgtcagtccccatataatactaccatcctgcctgtaaagaaaccaggtgagaaatacagatttcttcgggatctgaagggagttaatgaggcattagttccagtctacccaatagttcctaacccttatacaatattgacctaagtctctgaacatgctaattgattcacggtatgagacttaaaggatgctttcctttttatacctttgcgcccagactcctagtatattttaacttttgaatggactgatccagatgctcatgctacatctctgtttacctggaatgccttttcccaaagttttagggtcagtcctcatctctttggggatgtattggcaaaataattaagggaactacagttaatgaattgatccctcctaaaatatgtggatgacctataaatttccagccctactagggacgactctgataaaaatataattcaggtccttactttcttgggaaaataagggtatcgggtattctcccacaaggcccagacttctgtgcaaaaggttaaatacctgggatacatgcttattcctggaacaaggacaatagccaggaatgaaaagagaccactctggcactgcagcgccatcagactaagaaacagttaagaacctttttgggaatgggtggattctaccatatctggattccctggtttggggtcatagcaaaaccactctatgaagctctaaaagggaatgatcacgagcctttgaactgggatggaacctgccaacaggcattcctaaccttaaaagaaaatctgggaatggcccatgctttgtgactcccaaacttagaaaaacctttcactctctatgtggctgaaaaacaagggacagctttgggtgttctaactcaaaggctagggaataatcctagaccagggcttatttttctaaaaagctagatcaggtggtggccagatggccaggatgcttgtgagctgtggccaccaccattctattggtagaagaagccaggaagttagccaggcacggtggctcgtgcctgtaatcccaggactttgggaggccaaggcgggtggatcacgaggtcaggagatcgagaccatcctggccaacatggtgaaaccccatctttactaaaatacaaaaaaattagccgggtgtggtggcatgtgcctgtagtcccaggtcccagctactcaggaggctgaggcaggggaattgcttgaacccaggaggcggaggttgcagtgagccaagatcatgccactacactccagactggcaacagagcaagactctgtctcaaaaaaaaaaaaaaaaagccatgaagtcttccttgggacaaaaattagatgtcattactttccctcctcaatcaagtacactaggtcctagagcaaaaggacattaatggctaacagggagtcagttgctcaaatattagatccctctgttccacacccaagagtttacccttaaagtatgtcaggttttaaatcctgctactctgttgctggactcaatgtcccgagaacggaggaaaccatggaacagacctactctagcaggcttgaccttaaagataagtcctttcctaaccctgatgttaaatggtttacacacacacatacacacacacacacacacacacatatatatgcacacacacatactttttttttgagatggattctcactgcgtagcccaagttggagtgcaatggcatgatctcggctcactgcaacctccactccagggctcaagcaatttttgtgccttgaatcagtaaatatattgactcaagtcttttcccaatcagagagccctaattagagtgattaattccacttttttagcagaagtgtgaggaggtaaagctttggcctcaataacttcttgttggcctgccttctttactctctcatgaataaagctactcccatcagtaaaccatttaacatcggggttaggcagggacttacctattctggaatagcaggggctattccggactataaaaagggccaccagggcctgtgaactctgtgcctgtaacaactcaggaagccaccctatacccccacccctactcaagcctgcaatggggaagactggcaaataggtttcacccagatgccaccgtatacagaggactgaagtatttgctagtacttataacaatttcatcaggcggatagaagctttccccacaaggacagaaaaagcactggaagtgtccacattgttattttaaaaaaatcatcccaagttttgaattaccaacatatttgcaaagtgataagagaccttccttcacagctaaggtgacccagcaggtttcctcagccttaggcattatctatcatcttcactcctcctagaggcctcaatccttaggtaaggtagaaaaagacaatcatgttttaaataggacattagcaaaactgtcaggagacctcagagacctgggtatctctcctttccatggcccttttttgcataaggatggctctgaagggaaccttaaaacttagcccatttgaaatggcctatggggggcccttttttaacttcaggcttcctgtttgatgaggagacacacagaatgcttactcatattaacttagaccaggttcaaaaggcccttcaagaatatggaaataaggtatttccctttttcacaaacgaaaaaaaatagctcccctgttcaaccaggagacagagtcctattaaaaacttgggaagaaggatcccacgaggatcaattataaccaaaatggaaggtaccctaccaggcattgttaagcatccccactgctgttaaacttcagggagtcactagatgggtacacttgtccagaattaaacctgtttctcataagtccccacaggcacaagaggaggacactatgcccacaaaatcagtaggaggcagtgacagaggatggacctccatccttctacaacactttacgattaaagaggagtatataatctctgaaagggtaatgaggtagcagatcagcagggcttgttttctgagcactggtcataaccctgctgatcaggacaggatgtagcaaataaaccagcccaaaccagctaggactaggagttttactacattcgcacaaagacactcccacaagtgcatgacactttacaaattccatggcaacatcttgaagttactttatatggttccaggagctccctgccccttttctagaaagtttgtgaataacctgttccttattaagcatataactaagagtgaatataaagatagctagtccatgagtgccactctgcctatgggatagctctgctctgtctacggagcagccattttcctgtacatgttgctcaaataaacttgctttcttttactgttggctcactcttgaattctttcctggttgaagccaagaaccctcccaagctgagccccagtttttgggtttgcctgcatcagttctacatttcattctcatgccattctagtacaaacatgaagtgtaggggtgaggtgggaggcaataaagatagtccttccaaagccttgtatttccaccaggactcttggcagcgaatccctttcctctattggttagcctccttccccacagtgctgcaaccagctggttgtatttagggcttagttgaagtctgaaaccttgattttagtggcaccaacctgtgagcttaggagatgtattcctcccctccagttgcacctagtagacccaaaattagacaactgtattaattcaggatttgaggttgttacagaaggaaataaggcaggagaggattcttaggatctaagttggctaggagaagaaatgaaactaggagaagactaatagaatgcagaagggtcccaggacttaagtttctgagggacagtcatgggtgagcacaaggagtgtgaacaggtagtgaaaaatgtcctcaaagatgaggcaatcaaatgacttgattaatggtttattccctaaggctctaaagcacatggaatggatcattttggctgctgcagaaaccatgggtaagagaacatggtgaggtcctatagagcctaccaacccaagtcaaggagagccacaagtttcagtgtatgcaaatatgaggtcagcgccggtttggggaataggaaagacgcaggggctgtgtcgacttttggaggccagtccagaagtcgagtccaggcgatggtaggagctactccccagacctgagcacctctcctaacagcagctcaggcaaaggccacgtctcggaacagttggctgcacaggtcacgtgacgcgcccctagcccggctctatttggctgcaagagcgctctgtcgcctgcctcggactctgtttcccagaagtcttcctggaaactacatttcgcagggggctttgcggcgcctacttcctcctggctgattagatgggactggtgccgttggccggacgtttttgggagcttcacaggctgatggggaagggcgaaacctgctcgattaaaacaacccgcatttcgaggcgaggaagcgagtcacggctcggcccctccctttgtgaggagaaccaggcccgcctcggggtcccctgggcaatgtagtaacgtgaaggtctccgagtcccgctagcactcccggggcgtgggggtcccaagtgggactggaaccaccgcgaaagaggcggggctgcgcggatcttccacaccagctcctcccttccgtcagggggtgctgcgcatgaacgttttcccatctctacctcttggttatccctcagcagagattcttcttttactctgtacagttttcagcatccctcaagctgatatttcaattaaacaaattttagaattctgagaaatggcgaaataatgtaaaagaaacaaatgatattggccctaaattatcctccagcccctgctgctcatcggacactttatgaggttacaaaggaccatggcgctgcgcatatgggggatccattttacccaccgtacttagatcaggctgtgacttccgccctcgaggagcggctgctgctctaccgggtgtgctcatttagccctagcgttgtttgtgcgtttgaggacattcgctgagccaagctgcaagggtgtcgttatcattttacgaggggaatacggagagcatggtggataaaaggtggttgacctgcccaggctatacagctagaagtgccgttagaacttggtacaggtggaactgattctgatacttgtctcaaactgttaccagtggagggtgttcaggttcttggtgtcttgaacaaataattggacaaaacggcacaaacaaagcaagggaataatgaagtaacaaaagcagagatttattgaaaacgaaagtacatttcacagggtgggagcaggctgagcatgggggctcacgagcgctgttatagaattttctgggggttaaataccctctagaggtttccattggttagttggtgtatgccttatgtaaatgaataggttaaaagttacaaaggcattgtatgccctatgtaaataaagaggatatttcggcggggagttgtggcttacacctgtaatcccagcactttgggaggccaaggcgggcggatcacctgaggtcaggaattcgagaccagcctggtcagcatggtgaaaccccatctctactaaaaataaaaataaaaataaattagctgggcgtggtggcatgcgcctgtaatcccctggtggctgaggcaggagaatcacttgaaccgggcagaggtcacagtgagccgagatcgcgccgttgcactccagcctgggcgacagaacaagactcaaataaataataaataaataaataaaaaggatgtgtcttatcatagctgaagtgtttcatttgatttaattctagcaagtccttaagttccctgcctccaggccatattctgcctcaagacctatcctgtttacttcgtgtagcattagtttctttttcccaggtttgctgctacttacttggttaagccatgatcatctcggctgtactcacagtctcataaatccggtgtttattgagtgttagcaccgtgccaggcagtgtgttgagtgctgggacatggtgttgaacaggggcagacacaaccttaccttcatggtgtttacagcctaatggggaagacagttactgatcacataatacaaataagaataaaatgtcaaattgcgataaatagaacacccccacccccaggatgctacaagagagaataatggaggaaaattgatacattagattgattagggaaagaaagaaatgtttggtctgaaatgcttgaagaaggctgagaagaaggaagctgtgtaacagccaagagaagagtagtccaggcagagggatcagcaagtgcaaaggctctgagcggggaagagcttggtgttttgcaattcaaggaactcagagaagtcccttgtgattggaacacagtgaagtaggggagagtggaacaaattgagactggctttccttttaccagtcttgcctcttcttttcttttcttttttttgagacagagtttcactcttgttgcccaggctggagtgtagtggcacaatcttggctcaccgcaacctccacctcccaggttcaagcgattctcctgcctcagcctcatgagtagctgggattataggcatgcgccaccacgtccggctaattttgtatttttagtagagacggggtttctccatgttggtcaggctggtctcaaactcttgacctcaggtgatccacccgccgggcctcccaaagtgctgggattacaggtgtgagccactgcacccagcctagtcttgcctcttctaaaccatatccacactggcagtataggaatattttcagtactcaaatatgatgacttgactttcctttagaggctttgtgtcccctacaagttttagctcaaactcctcagcacagtgctcagagaccttcgtaattggatttacctcactttccagtcttccttttttgcaagttctgttatctctgcttggcatgccctctcctatgtgcttgctgatcaggcaaacttctattcacactttgtcttggctgaaatatcatcacctctgtgctctccttgtgcactctcaattcacttcttgtccccctgctgtgtaactactggtttgcctaccagtctttcccaagagacagtgagctcctcctcttggggatgtgttttctatctttgtatgatgcagaacacaaggcctggcagttgctcttttctttctttcttttctttttttttttttttgagacggattcttgctctgtcgcccaggctggagtccagtgcaatgtcggctcactgcaacctccgcctcccgggttcaagtgattctcctgcctcagcctcccaagtagctggattacaggcatgcgctaccacgcccagctaattttttgtatttagtagagatggggtttcaccatgttggtcaggctggtctcaaactcctgaactcaggtgacccaaagtgctgggattacagatgtgagccaccacacctggccattgctgttttcataacaaatattcattaagagaatgagtggaacagctagccatgactagcctccacttgtcacctgatgagaaggtgacatgtggttcttatccttggcagagtggaaattagcatccaaaaggacgcaagaagagatgagtaaaaaatctacacttacccatgagccagatactgtctcatccactgtctcatttaatctttgtgacaatcatagttctcagtttttgctgctaagaaaactggtgcccaaaggctctgcctaaagattacccaactagtaatggagaacctcggtaggaaattgggtctttctgatctcaaaggttgagcccctcaatattccttctgttctttttgccccatctggcacccgttactagcacagaagcccggaaagtttaagaaacaacttctgtctctggtgtgtcatttgtacctctgaggacatcaacttggaacagccattgtaccagagttctgtcttttccaggaatcagtgactcatatcagtctctgctgatatcagctgctgaagggcttaggagaactggtaggactcagaggagcagaaaatccaggaaagggcactcttggccagtgctgtttaatagaactctttcagatgagtaaaatgttccatatttgtgctttccagtatgggaatgtctcaagttcctttttagacagtatctccagccccctcattggttcctgacttcaggctgtttccaagacattcaacttgagactacagatccctgggctaggtcttcaagggccctccagatccaagctatgcctcagttttagctgaagttgtgtccaagaacacaggtcagggtacagggagatgggatacgtatagctccagacatggccagtgcattgttgatattgccaccccagcaaactgcctagaacttggcccagagcagatgctaggttaacatggtagatgagtgaatttactttctcttccccagattggggctccctcacctactgccattggcttctggaatccttctctatcattgtgaactgatgacttgccacatggtgaagattaacgaagccagtgctttgaaccaccaccctgacattttgggggtaggtcaggggggtagctacaaaaccagctagtaataattcattgaaaatatgctggatccagcatttttatgtaatgacctcatttttcttgtgaaaccctgtgtgcaaaatgaaagcccaaatgagcatctgctatatacagttaggagtagggtggtgctggggaaagaggactgatctaggagttaccctggacctggggctcataggctgtatgaccttgaacaagatgctcaatgcttctgtgccccagttttctctcaagtaaaataaaaacattggactctaagcttctttctacagttaatgtgaatgtttaaaaaatggctggtcacatctgtgatcaacctacattaagcacctttcaagtgattacttgcttcaattaggtccattttcattgtttacttttactaacagttttttttcttaacccttccacttccagtgccttcctcattcttcactattttttgattgtttcttcagattctgataaatcatcttcatttccagccattgaatcacctgctccttggccctgcctagaggctctttaatcctcagcagtttcaatttcctgacaaagcacacagagggggcccggtctccctcctcttcccttgcccactactcaccactctcccatctaaaacacatctgaaaaatcagggaggtttctattctggcagttgtctctctcaccactagatggcacatgcaggtcatcagtcttttgggcaaaaactaattttattgtgtatttaaactccatctcaatccacaaaagctttgaggggaattacaaaagtacaaaatatacaaaaggataagacaaaaagttgaggtagctggagaaaatagaaaacaagtggaagaaataactccaggatgacattagctcaaaaagatcaacaccagcaaaggcttacacatttggctccgagcttccaaatggccaaagtaaagagggaaatgtgagtggtaataaaattctagattttatgtgagaaaaacaaatatttgggagaagctcaacttttcctgaccctgagaccaaagagatatttttcccgtgggtcagctgactgaacagtgatgcaatacagcggtgacttaattggagctgtttcttataatgtccttttatgcaggcctatggcatgacgctcaagtataattgaggaaaagcagttctactgggcttaaaacatgagtttccaggacagagtaaattcactgtttgttgtgggcctccgtagtttgaaacagtgaaatctgcacacctccctgttccagagtttaggtggagtttgggggagagggggttcttcttggagactgtggtaagcagtttctaagagggccaccaatgatcctgcctcctggttttcaaaccctatctggtcccctcccatgtagcagcagtaatggtctgtgtcaccagcagaatgcaggagaagcagggccgggcatagtggcttatgcctataatcccagcactttgggaggccgaggcaggaggattgcttgagcccaggaattagagaccagcctggacaacaaaatgagacctcgtctctacaaaaaatacaaaaactagccaggcatggtggtgtgagtctgtagtcccagatactacggaggctgaggcgggataattgcttaagcccaggaggttgaggctgcagtgagctgtgttcatgccattgcactccagcctgggtgacagagcaagaccctgtctcgaacaaacaaacaaaaacaaaaacaccccaccaaaaacagaatacaggagaaattatggtatgtcacttctcagatcaggttaaaatacatcatagcttctctcttggtctctctgtctctggttttgtctctctctttctgtcatgctagggaaagccaggtgccatgtcattaggagtcttgagagacccatgtagtagagaactgagcctactgtcaacagccagtgtcaccttattagtcatgtcagagtaccaccttgggagcagatcctccagcctcagtcgagtcttcagagactaaatccctggctaacaccttaatggcaagaaacctcatgagagaccatgagccaggccattcagctaagtcacaccttggctctatgagataataaatgcttgttattttaagctgttaagttttggtataatttgttaagcaacaatagatgactaatacaaaggccaatagaaatccaaggttgcatcaaggataattttacatgggtaagtctacttggtttcagagaccaagagaatatttcagaagcaactcaagtgggcattatttttaacttttagtttaatttaatttaattttttaaaagacaagtcaaatttcacagtggggcgttgcatagcaatcttagtgacactaatgttaataaatttggatgacgtactacccttggaccagcccatgggggcttcaagtctgatagatatgggctcatattcagtctgtgaatgtagaaagacagaggtagagggatccatgtaaaatgtctgcaaaggagatttctctgaagaaggactgtgggggcaaggacttcaacttccttattcatggtgacatcatcggtgcctagcacagaacctggcacgtggtaggctttctacaaatctttcttttctttttctttcttttttttttttttttgagacacagttttgctctgttgcccaggctggagtgcaatcttggctcactgcaacctctgcctcctggattcaagtgattctcctgactcagcctcctgagtagctgggactacaggcacacgccaccacgcctggataatttttgtatctttagtagagacagggtttcaccatgttggccaggatggtcttgatctcctgatctcatgatccacccgccttggcctcccaaagtgctgggattacaggcatgagccaccccgcccggcctacaaatatttctttgatgaatctatgagtggtgagctacaaccttgagtgagctattcatgtatctgggtaaccatcatttattaagctcctaccatgtgccatgtacacgatgttggttaagtcccagggaacttttgtgtcatatacagattcaaatccactttgtgccccccactgcaccttctctcaccctgtgttttctccttgaaactctttattattattactattttttctttttttttttgagacggagtctcactctgttgcccaggctggagtgcagtggtgtgatatcggctcactgcaagctccgcctcctgggctcacgccgttctcctgcctcagcctcccaggtagctgggactacaggcgcccgccaccatgcctggctaattttttgtattttttagtagagatggggtttcaccatggtctcgatctcctgacctcgtgatccgcccgcctcagcctcccaattttttctttttttttgagacagaggctggctctctcacccaggctggagtacaatggcgcgatctcagctcactgcaacctatacttcctgggttcaagtgattctcctgcctcagcctcctgagtagcttggattacaggcacccgccatcatgccaggccaatttttgtattttagtggagacgaggtttcaccatgttggccaggctggttttgaattcctcctgacctcaggtgatccacccgccttggcctcccaaagtgctgggattacaggtgtaagcacccagccgaaactctttattacttgtgtagagattgtgcttttgcttccacactgaacggttctcatggaaatagtgttcttaatcaccatcacaagtaatctggtcgctgtttttccagtatgagaactagagttgctcaggacattgggtttattttgtgcaattttgtcttggggcctgtgctactgctttttttcctctttgtttttgttgaaaagcgacttgaaatgattggtgaactaataccagttcaattgtactgtgatgacaattttttttttttgagacatagtctctctctgtcacccaggctggagtacagtggcacgatctcagctcactgcaacctccacctcccaggctcaagtgatcctccccgctcagcctcccaagtagctgggactgcaggttcatgccatcacacccagctattttttgtattttttgtagagatggggtctccccctgttgcccagactagtcttgaactcctggcttcaagcgatcctcctgctttggccttgattacaggcatatgacaactacctgaatctatattcccctcttcacactgactttggtgctgtggttaaccaaatgttaccgtaatggagatactttgggtgtgaaggagaatcaaacagaatgatttgcctcagaccttgtgtcctccctttcagtaaaacattcctttctccatggttggccctgcactacttccttcttctccctccgcatagctattatttattgcctactccattcccatcaccaagttccacaagtgttatgtgcattactaaatctgggcggggaactgtgaattgccttgccatttttgttagtcagctactttgagagatggacaccaagatgggatgaaacatgcagttgttttacaaggggaaatgcttgtgtgaaaggaaggagggagggagctagagaaggccaggagagccaccagccccaagaaaaggagagagggagagaagcctgggttgttggcattctgaaggaaggagcattctaacaaaggttctgcaaaaccctcagggagtccttgagccaaagtcagctagcaaaggagtctcttgtctgttaggactgggtctgactctgtactcagcactccgtcattggtggggtgcatctccaggggaggcgtggccaatggattttaaagcacagcagctggtgccctcagctccctgcagtgagaagtttgcagaggcacattcttgtgactgagacaccaattttttttttttttttttgagacagaatcttgttctgttaccaaggctggagtgcagtggcatgatatcagctcactgcaacctctgcctcctgggttcaaacgattcttgtgcttcagcctcccaagcagctaggactacaggcgcacaccaccttgccccactaagttttgtatttttagtagagatggggttcctccatgttggccagactggtcttgaactcctgaccttaggagatctacctgcctcggcctcccaaagtgctgggaatacaggcgtgagccactgagcctggctgaaacaccaatatttattttcctcttttttgtttttttttttgtattttttttttttaaataacagaagcctgatttatttggggtggcaaagacctgatattgaatgaaaagatcctagccttctttgcaactaggtgtgggcctgtgtctaagttctgatcaatgcaatataaaccagaagtatcacgaggaccttccagatactccccttaaggggatctggcctgcctgggtggtgaatcccttcttctcttctctttacccagggctatagacaaaatggctgcagcctcagttgccattttgtgtcaagaggcaatgtgttactgatgaaagggcagactaacagcaagacactttcctcccagacctcatacccgctctggattgcttacctctagacttagacctgagagaaaaataaacccccttgtttaagccattgttattttgtttttgttataagcagataattctaatcctatttagtacggtatctattcttcacaacagctctgccaggcaggcacatttatgcccattttatagaaagtgaagcacagaatgattaagtgttagaacctaaattagaccccagggtggcacttaggatagttttagctgtgaataactgaacagagtttctcagtcttctctgaagataataattgcctggggagcttgctaaatatatataacagactgctggccttccccgtggacatgctcgctcagtaggtccaggttaaggccttgggaagctactttatctcaaacaagcagtccaggctctctttatcctcaggaagcccatgtgaatcctaaggtggatgaagaccaagagcaggcagctcacacagtaaggaggtagatactttgccttagaagacttccgtgagcataggaatcatttgcagagcttgatagtatcatttgtggagatttcagattctgggctccagtttttatttttaaaaagtcagtacatctttcatggaacctgggcttttggatttttgtaaagctcccacatgagcctgttgcatgtgattcatagagtccagcttgagggactctggcttaataggagcacaggcattggagtgtgatgaactggggtttgaatcccattgctgcatttatttgctggatgacctgtagcaggctaattaaggcttctgtgtctcaggttttaccatttttgaattgaagaaaaaattataaggcttacctcgcagagttgttgtaaggattaaatgagataatttatgtaaaactcttagctttgcataaatatgctctcaataaatggtggctattgttattatcataccccatgcacacatcttgcaaacagtatgggcacagagttctattactatggaaaatttatacaaatcttcagggaatcacgattcagcgaaggctggtacagggagctgggactcccctttctctccccagcgacctctggccctgagagtgagtgacctgcctgtgcatgcagagattgagtaaagttcttacaggatacactcttatgtcccccagcagccaccttctactctcctttttttctctcttctttcccaaccggtctgtccaagaattaccgtctacactcaatggctcaattttctcatttcccatccccttctccattcactgcagtctgaattctgctgtcactgctttactgaagtgactccaagaggccaccagtggcttccatgttgctaaatccacgggttcttttaaagtcctcatctcgtttgagtcctctgcaacttttgctgctgctgtctgcttattccttcttggaacttttctctcttggcttccaggactccattgctgtttctccttctaaatctgtgatcgctttctttagcttttatggaacctctacctcatccatgtcttctacagctctgttctctatcattttgatccttcatttgctcttagttcctttttttctctgaccagagcccactatcactgaactcttcaaagttcgaggtattaataaattatctgccttcttaggatatcctggtctaatgtgaccttttccttctttcctccatggggcagcttaagacaggcccaaggagtgtgctccagtctccttcacaggtgttcctaggaagctcagcaacacccattaaaacagaacgtggatttcctgtagattaggccccggggagacactgagatacccttgtttccagttatactgctgggggagacagagtcattccatccatccccttagctcaggccttaaggccttgtgtctaggtctttgttctgctgacacccagtgcctttcagaggagttgggcccattcctgacactgacttgatagacattgggccttgcttttacctttgtggttttggctttctcatcaatgaaatgtgaaaattggacgactcaatttcgcattgaataacccattatttttgatttagaagtgactctgaggtcacttttaactctctggcaccatcatgaccagctttttcatcaattgcgcaaccttaataccactcctaggactctcctacggaaatcctctcccaagttcatgaagacgtatgcctacaagaacgttcacttgtatgaacccaattgctcatcaagaggggactggttaaataacttatgaaagtacttgctctggggctgtactgctcaaaatagatagcctgttgtttgttactggtctgctaggagataaagaacttgagccagaatgtaaatcaatgactttatcaagagtctttctgacaaaatatatatatatttacagttgacccttgaacaacatgggtttgaactgcacaagtccattcatatgtggatttatttcaatgaaagttacaccgaatatgcctgcctgtcctacctccctttccccttctccacctcttccacctctgccacctcggaggcagcaagaccaaagtttccttttcttcctcctcctcctcctcagtctactcagtgtgaagatggtgaggatgtagacctttatgacagtccacttccaactaatgaatagcaaatatattttccttattttattattttattttctctagcttagtttcttgtaataatacagtatataatacataaaacatacaacatatgtgtcaatcgactgtttatgttgatcagtaggtttccagtcaacagtaggatattaatagttacattttgggggtagtcaaaagttatggatggattttcgattgcatagggggatgatgcccctaacccctgcgttattcaatggtcatgggtatatatcaacagaaataaacagtgcgcttagagacgtaattgatttgcattctggtgcaagctcctcccttatcttttctcaaaccagtagcaaacagtctctgcactggtaaacagaccaaactttgagtagcattgctaaagtgtaacagaaatgagctacggatgtagagcaaacaatgtctaagatacattgtttgtttgtctcactctgtcttccagtctggagtgctggatcatatagctcaccgcagcctcaaactcctgggctcaagtgattctcccatctcagcttcctgagtagctgggactgcaggcgcataccagcatacctggcaaatttttaatttattttttgggcagagacagggtcttgctatgttgctcaggctggtctcaaattcctggcctcaagtgattcacctgtctcggccttgaaaagtgttgggattacaggtgtgagccacagtatctggccaaaatacactgttaaaagaaaaaagtatgctccagaacagtatggtgttttcaaaagcaatgctctagacaaaaaggggtatataggcacagagatatgttggtagatgcacgaaacatttctggaataagtcctaagaaataaacagtgtttacctctggggagtgcagctgggagtctggggtgagagacctctttctttgttgtatatccaatctgctgtacagtaggtactccccagtacagtatagtggcttggaatctgtcatcctgattagtctgtgccctagttgcaacagtcattaaatattttgaatgtcactccttttactgtttgaacaacaacaacaacaacaacaaaacgcacaaaaaccaaaaaatactacatgcatgcatcactttctttcttttctgttttttttgagacggagtttcgctcttgttgcccaagctggagtgcaatggcgccatctcggctcactgcaacctccatctcccaggttcaaaccattctcctgcctcagcctcccgagtagctgggattacagatgcctgccactgcgccctggtaattttttgtatttttagtagatatggggtttcaccatgttggtcaggctgttcttgaactcctgacctcaggtggtacacctgcctcggcctcccaaagtgctgggattacagacatgagccactatgcccggtcatcacttttgtatttaaaaacaaactagtggctgggtgcagtggctcacgcctataatcccagcactttgggaggccgaggcggtcagatcatgaggtcaggagtttgagaccagcctggccaacatggtgaaaccccgtctctactaaaaatacaaaaaattagctgggtatggtcgcacacacctgtaatcccagctacttgggaggctgaggcaggagaatcacttgaacccgggaggcggaggttgcagtgagctgagatcgcgccattgcactccagccagggcgaccaagcaagactccatcagaaagaaagaaagaaagaaagaaagaaagaaagaaagaaagaaagaaagaaagaaagaaagaaagaaggaaagaaagaaggaaagaaagaaggaaggaaggaaggaaggaaggaaggaaggaaggaaggaaggaaaggaaggaaggaaggaggaaggaaggagggaaggaaggaaggaaggaaggaaggaaggaaggagaaagaaagaaaggaaggaaagaaaagaaagaaagaaagaaggaagaaagaaagaagaaagaaagaaaggaagaaagaaagaaagaaagaaagaaagaaagaaagaaagaaagaaaaactagctatagagagaacactgatctcctagagcccccatttgctgaataacaagcctccttgtttcatttttcacaaacatttcttccctctgttctctccactgggtctatgaacaagggtttgctctctgtcggtgctttggcgttcttctcctgcagatatattcacaagaagtcatcttggttcacagcctcatgatgaagagggctcaggggccagagggctgattatggttctaatttgcaattatacagtgatttttcacactgctcatgaatgctgacttcctccctgtttgggttggagagttagagggatctgatttgattgaagcagtataggctgtgattatcataagaatttggcatagtaaattgaattgggaagtattgggcaacaaatgtaaattatttcctttcatttgtcactcctacacaactgtatatttactgtttgtggctgaccctgtgtagaaaagtgaaatgacttaatcctaatgcctttgaaatgggaactgttgagacacctgagtggtctctttgaattcaagatgcaaacagattgcgctgctgtttggagggagcatggagctgaaacaatatccctggagtctagtagtttttttttttttaagttcaagtgctctaggcccacctactgtggttctagatggatgttttaaatatttgcattttaaaatattttaaaaactcttatttctgtgtaataaaaaagttcggccaggcgcagtggctcatgcccataatcccagcactttgggaggccgaggtgggcagatcaccaaaggtcaggagtttgagaccagcctggtctacttggtgaaaccctgtctctactgaaaatacacaaaaaaaaaaaaaaacaacagctgggtgtggtgatgggtgcctgttatcccagctactggggaggctgaggcaggagaattgcttgaacctgggaggtggaggatgcagtgagctgagatcgtgccactgcacttcagcctggacgaaaaaatgaaaacgttggcttgcctttgtcctgggttcttagaaggtagataacctgtaaataattggaattttctgattgagaagagtgtcttcgtttttcatggtggacctcaatagtttaagctaatgagatgactcaatatgggagcgggccacactaggaagaaccatggtgtgattagagggatggggtttttagccatgtgatatcactcctcagaggaagaggagacggggcatagccaatgattcaatcgattgctcctacaaagtaagaccccaataaaagctctagacactgtaatttaggtgagcttccctgattggcaataccttgtgtattgtcacatattaatgtgcggggagggcaataagccctgactccactaggagaagacaatggaagttttgcatctggaaccctctcagaccttggcctatgtattctccttgtggctggttctgattcatatccttgtgctataataaaactacaattgtaagtacagaactttcctgagttctgtgagtcattctagtgagttatcaaacttgagggggtaacgagcactcccgagtttgtagccagttgatcagatgtgagagtggcctggggacccccaaacttgcagctggtgtctgaagtgaaggcagtcttctggaggattatacccatggcttgtgaagtttggcctaactctggatagttggtcttagaagtcattgcaatttctttaactttttatcttgaaaaatttaaaacttaaagaaaatttgcaagtgtagtacaatgaatacccatatacttttcacttagagtctccaatttgttaatgcattcccatatttgtgtcatttctctttctgtatatacttttttttttcctgaaccaattgaaagttgcaaacatgtcatccctaaacacttcagtacataccttctgagaaccaggacattctcctacataattccaatagcatgatcactcacaagaaatttagcattgatacaataatattatctaatatgtttctattttccctattgtccttaaaataacccttataattttttcctttcaatttaggaggatccagtcaagggtcatgtattcctttggttgttatgtctccttggtttccttaaatcaagattccagaactgtctccttgctttatttgtttttgagacagagtcttgctctgttgcccagataggagtacagtggcacgatcttggctcactgcaacctccacctcccgggttcaagcaattctcctgcctcagcctgcccagtagctgggattacaggcgcctgccactgtgcttagctaatttttgtatttttaatagagacggggtttcaccatgttggccaggctggtctggaactcctgacctttcaggtgatccacccccctcggcctcccagagtgctgggattacaggcgtgagccactgcgcctggcctgtctccttgtttttttgtttttttttgagacagagtctctctctgtcgcccaggctgtagtgcagtggcgcggatctcggctcactgcaagctccgcctcccgggttcatgccattctcctgcctcagcctcccgaatagctgggactacaggcgcccgccaccgcacccagctaattttttgtatttttagtagagacggggtttcactgtgttacccaggatggtctcaatctcctgaccttggattacaggcgtgagccactgcgcccagccttgttttttattttaatttaatttaattttgtctgtaatgaaattgacgcttttgaaagggccacactacctgacttgtatattgtaaattgtaatctcaatttgtctgattgttttctcgtaattagattcagattatatatccttagcaagaatacaaactatgtagatgatgtgttgatgaaaagtttgtactagtgtgatgtcaaccaagatggcagagtagaagatcccttggcatcactcctctcaaaaaaatacaactagaaactattcaagaccagaataccaccctgagttcaccaacacaccaacacttggaggagaagtggagaaaaccctggacgaacagaattgagaaaatctgtgaccggtaagggaagtcatcatttcagactgtgctgtcccctcccctaaccaggcagaatgctacggacagagaatttcccccaatccattgtttcaagagttagaggagggaattgggggtggatgtttgatctctccatggtctgggaatcttcaagggaagtccactctggtcctgtcccatgggaacctttgggagtgctgggagggctgaaccacctgggatgacttagagacaaagagcaggatgccgattgcagcactggcacttggatcttggtggctactctgtgctctgattggtggggatgccatgttgaagagactggctggagtcatagtgctgcaggggcacagtccatggaaaggcccaaatgcctggctggattttccacaatgcccaggtacttgcagaaagcgtttccttggccaggagacaactaaaaggtcaggattaagttccagtacctgcttaagtcttccccatactgagaaactatggcagggtggccatatagttctggggcaacatttagcctcctgtgtttactataagttttccctagaccaagaaacaatgacaaagcaacaatttagctccagtgcagtgttttagttctggtgcttgctgtaagtcctccccagaatgggcagaaacaacaggccagcatttaaattccaatactaagtagtaaaggtctaaaacaagcaaagaacacctgcaaaaactagaagaggtgcctgtttcctcagatatgcaaacatcagtgtaaagatgtaaagactgtgaaaactcaggaaaatatgacatcaccaaaaaaaaccaacaaagttctaacaacaggcccagaagaattgaagatctatgaaatgtgagacagagaattcagaatcctcttaaacaagttaagggaatcataagaaaatacaaatagaaaattaaataaaacttggaaaacagggtgggtgtggtggctcacacctgtaatcccagcactttgggaggccgaggcaggcagatcacaaggtcaggagttcaagaccagcctggccaacatggcgaaaccccgtctctactaaaaatacaaaaattagccaggcgtggtggtgcgcacctgtaatcccagctacttgggaggccgaggcaagagactcacttgaacccaggaggcagaggttgcagtgagctgagatcgtgccactgcactccagcctgggcaacagggtgagactcagtctcaaacaaacaaacaaaaaaacttggaaaacaatcgaggaacaaaattagaaatttgacaaagacataggaataatttaaaaaatcggatagaaattctaggaatacagactagaataactgaactgaaaaacgcattagatagcttcaacagcagacttgatcaaactgaggaaagaattagcaagcttgaaaacaaaatatatgaaattatccaatcagagggtaaaaagaaaggtttggactggaaaagagaaaaagtacatcagcagtgaggtgcaagcatatcacacacggcacatagaagaactgcatgggccaagggccacaacttgtggtggagacagttttacagagcaggaatgttggagttacctgaggctcatttcttattctcctttttctttttcttttttttttcttcagctgtgactccagacatgattcaaagaggaattttgcaatatcatttctgggttttacggaaacttactttacctttctgtgttaggctcttaaagcactgtgtcaaccttaaaaggacacaggaaagggcttgtcacttttctgacaccatctaatcccagctcattccaaggctaagagggttctcacatgtccatctctagcccagcctgcttccctaaacacagtcctgatactcagctacttactttcatctcaaaggtggtctcaaagatccctcatgctaacatgttcagcattcaactcttgagtctctacaccagtccccttccccccagcatgagtctacatccccatgagtctacaccaccacccactcagttatgtgagctagaaacctggacatcatccttgatgccagcttcttttccccctcctcctgtagccagtccatcaccaagtcccgctgttttgaccacctaaataatgatcaaatccattcattctctccatctactctactaccagcttagtccaagccatgattctactacaccctcctagcagatctcttggcttccacacaggcacacttctgaatctcatctccatacagcaaccaaaatatctcttaagagtgtaaatctgatcacctgtccccctacttaggaccctttaatggattcttactgctctttcaaaaaagaaaaaaatcttttctcaggctcctggccactgtccatagcattcaagtataccattcttcctcttgctgtctgcactgctgctacactgtctttctgtttcttaaaccccaaacaattcctctcccttccttcttcccaagacacacacacacacacacacacacacacacacacacacacacacactgattcccttcacgtgtgttcttccttcatgtctttgctcatcagtcccttcactcatggaagccccctcttatacactcttagaatactctattttttactctgagctcttattacagataatatttctacagttgttcaacatttcattcagatctgcctttcctacttccaagctccaaaggacaatgatcacatctgtcttcttcctctgggtagccttatcacgtagcacagtgcctggcactaagtgaactctcaataaatatttgggggtgcatgaatcatctctagaaggcccagtgagaattccaaagggcatgtgcacccatgcaaacattaaggaatttattccgtactctcttataatcttggtaagtttgataaaatattatctattttatctgctcagtctgacttcaaaagtccatgggggaaatttttatttcaaagcacttcctatacttaaacttttgaaaaggaagaacgactagtatttctcccatatttccattctgtcttgagccatctaagctcagaggctggccaaggcagcaaatgaagtgagaggccattgatatgcaaatatgatcattatcactgaaggccacaccccagaacttgatctcagcgctttcacagccaaagccaatttacattaaaaaaattaattttccaaacttgaatttaatttccaaagctaaaatgcatagaaattaaactactaaaacattgcattttcaatagaacacattgctattttttggagtgagagttggctgtcttccaacaattaggttctgtttggcttgtgaaagaggttctgggttgttaaggatggatactcttgaccttggactgacctctgcagtttccctggagcacggacagccaagcagtaaagtagatgctggtggagatattgctactgtttttgagaaatggaagctgagacccagaaagactatgtgatatattgaagactcaaatccaagtcttcagattctaagtactgaggtcctttctcaacattttctcttaaaatgtttggctctttagggcagagcccagactcaccaatgccacacatgcctcccatttgcctgctagactttagagctttggaatggatctgcaatctcatagaaaagaggtaaagcaaattccttccaggtcatagcaagagggtggggtgtcctttaactgtcctgatgcctaaatttggttttacacaaaatccccaagatgctgtaaaatcacttttgtagctggatgccagggtcagaattgatgacttgagaggcagaggagcagagcttctgctatgacctcaggaaaatgagatgtggctgctgaagcccagagcttggctcccagcaaacctcagccctggttgccaatgccatctcccactgctgatggatgatggcccactggctcctgcacctgtggatagctctgatttctgctttcaacctgtagccacgtagcctttggattaaaatattgtcctctgattcagatgattcttttcttctctgcaacagggccaccgtaggacatatatagtagttagcagtgcaggttttgctgttcactagctctctggtctttagcaaatgacatctttttttttttttgagatggagtctcgctctgtctcccaggctggagtgcagtggcaccatctcggctcactgcaagctctacctcctgggttcaagccattctcctgcctcagccttctgagtagctgggactacaggcacccgccaccacgcctggctaattttttttttttttgtatttttagtagagacggggtttcaccgtgttagccaggatggtctcaatctcctgaccttgtgatccgtctgcctcggcctcccaaagtgctgggattacaggcgtgagccaccgctcccagccacaaatgacatctttgatccttggtttccccttctttattaatagactctgtaaagaaggtttcctgtgcgctggttacccactggtctgagtttggtgagacagaacacccatgctcacaacaagttaagtaaacaagcttattacttacagataggcaggcagcaagggacaacagaaaccgaggattcattgccacccagtcctccaaggttcaggaaagctgcctgggtggatggagtctcaactgcatgtgctccactttcatagcagctgagggacctcagaaagcagcccacactgagttttatacctcggggttacaagaccctctgggctaagcctggaaggacatctcatttctagggagggattggaacagagcctggactgtcctgaccagctcccctcttatctcaggatgttttatttccagcatgtcctgcagttattcttgagaactacagataagaaatggggggagaactgtcttggtctaaggccacccagagaactgtgctgcagatcccacatctagagttctcttgagggtcaaatgagatatcataatgggaaatgcttagcttagtacctgatatgtagcattttaaaaaaggtagttattaagttagaaaagggactatctgcaggatccctgcatgggaagaatgcatggggacactgcatgcagatgcttaggaatgctttgtgacaaacaacatcatgggaggtggcagctcaagaaagttgatcatacttgtgcttttgaaaccttgtgagcagtgttaaagcagaaatatgaaagggaaaacctttacatgacagctttctatgttttattgacatcctggctaagctggctccctgacctgggtctggttgattcagagctggtgaacaatcattatcttgcacaaggatgcactaggaaggaccacactctagcccagctggtcatgcagtcatgttgggaagtgctggttggcccagggaagccattcctgatggatcagaggaaaagggaagggagaagtaaatatgaaaagaagctcaagcccaggctatgaccaggagagccaatccttcatttggagcgccactctttctttgcccagaaacctgcaggtacatgcaagtccctgggagtggctccaggaagcccccctcgggctctatgttgctttttttgagttagactctctggcatagactttgtctttgaaagaggatttgtaagtcgctgtttatttattcttttactcattcattccacattcatagagcactggattagtcaggttctccagagaaatagaaccaacagaaatagaaccaaagacatgcattataagaaattgtcttacatgattatggaggctgacgtgtcccaagatctgcagggtgagttggcaagctggaggctcaggagggccaatggtgtagttgtggtctgaaggctagcaagcttgagaccaaaaaaaagctgatgtttaagctctagcataaaggcaggaaaaactcaaagtccagtttgaagactgctgagtaggaataattccctcttatttgggagaggatcagcctttttttctattcaggccttcaactgataggacaaggcccactcacactggggagagccaacctaatttactcagctcattggtttaaatgttaatctcattcaaaaacaccctcacagacacacctggaataatgtttgaccaaatatctgggcaccctatggcccagttaagttgagacataaaattaatcatcacagggaccaacaatgtgtcaggcatattccaagacaccagggacacagcagagaacaaataaacatgagccctgccttcatggagtttaccctttagagggagggtggatcaaaaatcaagtcaatgaataagacttttagtgaaggatgagcattatgatcaagggtggctgtttcattctggtgatcagggaggacttttctgggcaggtgacacttgaatggagacctaattacataaaggagctggccatagaatgtgctgggggtaggggggtgtgttctaggcaggggagtaaccaggcaggactgagcttggtgaatctcaggaacagaaggctggtggggggagcatggttccgggtgggggcagggtaggggtcagtgggggaccagagaaggcagaggacagatcatgcagagcctgtaggctggggaaggaggctgcgtgttattcattcggcctgctgactcaccccagtccttggctaggacagcaaccctgctgaaggaccaggatctaaaagtgtcccttccctcagcaatgatgcccacacttctgtgcctttgcacaagctgttctctctgctgggatgccttccccacgttctctgtccagagattgcccagatatcctttaagacccagcttacattgcaccccctctccaaagcctttccaggattttctgggcagtgagccagcctctcctctgtgcagccatagtcctttgtaaatacactaatgctcacattgattagctgcattgtcattttatagttctgagcctctctcatcctcctctgcttgtcagggccagtgtctaatcctctatctgtccccagcatccagtccatattgaccatatgaatgtgtgctgaaggttctgattgaaccttagggctggctctctccagcttcaatcttccttgccatctcctcctccctccttaaccctccatctgtgttactcatggccaagctggacggggagctctaaaccttgtcggatccactgcaacaagttttgggccttggaaagcctgcattagagctttagaaatagacaaatacacattgtcctgtccagagtcccatttccaaggtggagattcatcaatatttttggccactcagcatctaatccttcttcttcaaaacatctgacttcctctgggaggatcataataaaatcccattataactcttttatgttccggggctgttctaaaagcttcacatttgttaactcagttagtcctcataatagccctattagctgagggctattattatccctatgcaaaaggggcatagggaggtcaagtaatttacccagggtcacacagtagtgacaagcagtctagtgacaagcagtctagcccaatccttgctctttaccatgactttactgccatggtgtgcagacttgatttgctctcccactgcaggatctaagggtcctaccatttcttcagtcaaatccttcctctcatatcctagtagagccagagggtgggcagatggcctaaattagtcaagatgactcttccaggacttgaagttgaaaggatgtaaagtgtgaagatgcagcagctgtcttggaaccatgagggtcacatttggttgagaaggcagctgagagcagaaggtgaatagagatgagtggagaggcagtgagaagtggactctagctgtattagttttctattgttgttgtaacaaattaccataaacttagcagctttaaaccacacaaatgtattatcttacagttctggagatcagaagtctgaaatgtattttactaggtgaaagccaaggtgttggcaggtgcctttgtgtgtttgggcagctatcttagtctgggcaatttataaacaacataaatcattactcatacttctggaggctgagaagtccaagatgctggcagatttggtgtctgatgaggggcctgctccctgcttcaaagatagtaccctctggctgtgccctcacatggtggaagggacaaacaaattcctttaggcctcttatataaggaccctatcccctaaaaccatcaccttgggggttaggatttcaacatatgaatttgggtggacacacatattcagacatagcagcagagctctgtttcttcaggagtctctaggggagaatgtgttttcttgacattttcagcatctggagttccattccttgggtcttggcttcttcttccatcttcaaaacatagcatcttcaaatctctctctgcttctattgtcacgtgaccttctctgactctgactccttctctgtccttcttataaggaccatcgtgattacatcgggcctgcccagatgtccagcataacctctctatcttgcgatccttcacttaatctcctctgcaaagtcccttttgccctatcaggtaacaatcacaggttccagggattaggacatggacattttggggactgttattcagcctgccacactgacatcttccctgctcagccacgccaggctggcagggtggcccccatggggaagaagtgtttttttcaggattccttgcttgtgccagtcccaggaggcagaacatacagtagcagcgatggcagtcaccttccactacaaactctggagttgcaactgtggttcaaggacagatatttctctgagaaccatctccttgggcacagcagcagaattccatctgctgcagagagcttaccacattcccagaacctctagctgagcctcatatcttttctgagaggcagcctgggctgtgtttactcatggatgtatccaggtggaattgttacttccagagaagatcaaaaataggagcttggtcttcagattttcctgtttctcactgtccttggagaaagagaaatcaaggaggttggagacaggccttccaaaggagctagagggaggggccctggaaatgtcatgctgggcaaaagacataaatattccttttttttttttttttgagaccgagtcttgctctgtcgcccaggctggagtgcagtggcgtgatctcagctcactgcaagctccgcctcccgggttcacaccattcttctacctcagcctcccgagtagctgggactacaggcacccaccaccacgcccgactaattttttgtatttttagtagagacagggtttcaccatgttagccagaatggtctcgatctcatgaccctcatgaccttgtgatctgccctccttgtcctcccaaagtgctgggattacaggcgtgagccactgcacggagcataaatattcttttattaaagtaacactatcaataacaataatatttaatatgcttgaaattaaaattaaatttgaaaatattttaatttaataaatattaaaatttaaaaatgtattgtcactgagtggtaagcacttaatttacattattatttattttattaaaaataattggccaggtgcggtggctcacacctgtaatcctagacctttgggaagctgagggaggtggatcacctgaagccaggagtttgagaccagcctggccaacatggtgaaaccccgtctctactaaaaagttatatatatatatatatatatatatatataaaactgtatatatgtgtgtatatatatataaaactgtatatatatgtgtatatatatatatatatatatatatatatatatatatatatatacagaaattagccaggtgtggttgtggccatctgtaatcccagctacttgggaggctgaggcaggagaattgcttgaacccaggggatgaaggttgcagtgagccaagatcgcaccacttcactccagcctaggccaaagaacaaaacttcatctcaaaaaataaaataaaataaaataaaatatgtataagaagatatgctataaaaatataagctctcttcttaccccagtctgtttctctcctcagaaacattgtttcttgcacattcttctagaatttaaaaaatccatgagcaatcatatatgagactgctctttaaataaaaacaaatggctacattttatacatctcatgctgtttcttgttttttttttttacagggaaggatatatcttggcaagttttttcattttatcctaaatagatctactttatttttttaaagtgacatgtttttttgttttgtagatgtgccataatttattaaaacaccttccttttgagggatatttaggttgttcccagtcttttgctcttatagaaaacccagaaataaaaatcctccctgtattccgttgcatacaggtataagttcgtaagtagaataaattcctgtgagtaaaattcctaggtcttctctctttagtcataattatcctatgaagcaggtattattattattttcacttagatggggaaatagcaatactgacaggctaaggtaacttgcctaatgaattattggttgagattggattaaagcatactgagaacctcagtcttctaggggctctagacttcttgatattagaaagagttctaatttttttgctcaggaccaaatgggaacctgtgtcctagttgtgtgaatcaggatagggtaggttatgctgctgtacaaatcaatcctcaaagctggtgtttgaacaagatgaaagtttatttcttgcttctgaaatgtctgatggagcctctgggtgctctccttcctctggtgattcagccattcaggctctctgagatacctgcatctcaacacatgattatttgacatccctgcagcagggaaagaaagaaagagggccctagaaggtataccagctcttacctacatgggctagaagtgatgcagtttatatctgctcacattccattgtgataggaacccaatatctggattcagggttgggggaaagaggagccaccacttaattcccaagagtcactgcttcacatcttcattaatagaaatttattttactgatggatatcattggttttctacccaacagcctttctttgattcttctctgctaagagaatcttgattctgctccagaagaaatgtgccccgcttcagtcctcttaccttttgatagtgattggtctagaagtcgacatgtgactcagctttggtgaatagaggaaagggatgtccgctggggcttctgggaaactttacttcctaataagatagagcagccatttagttgcaagtctccttccttcctgctttgtgcattaacttgcaaagatgttgaggcagccatcttgatatcctgagagcagacatgaggatgagtggaaagagccccaggagtgctttgatgactcttgaagacattgttgagttacccctcccccaacatatatctgaacttcttaagtaaacaatacacattcttatggtttaagcagtttttagtgacgttttctgttacttgcagctgaaaacattcccaactggtacaatgctgtgccctttgctcgatgctggggaatggagctgaattgtgtatatctcctgccctcaaggagctcacagtccagtggagaagcacctcatgggagcaatatttgggcttgaatgaaatgtgctgatagtgttgagccgggaagaagtagtggtgtggaagggtcgggtgcctggtgagtggtcccacacgtccttctgtcctgtcattcttagtcccacaggactctcaggacatgagccttgattgccaggaagtgggcagctttctgtctttgaaggcaggggctcacttttcagagaagcgttcctgttacaccagggctacaaattaacacattattttaggccatttctggaccataattttatcctccccttagcgatttactgcatgcaaattttccactctatgcaaatcactcactttacggaaatcatctatcatatgttcccaagccctagcacctgcaccaggaagaattggatgattcagtccttggagcattaaagtgcaaacacttaactcaaagaatctcttgggggatagttgagcgttggatgccaagatcagcagcctctgcagatagcctgcttagcttacagggtgtgctgaactctgctgcctcccctcacccctcttccctagctacttacaagccccttccaggtggtaatgactatttggagtaaatattttgatgtgacagaatgattaagtccagactggctcggcaaagaaccttaaggcaattaggtttcccaatcagtgtaggtgggtacatctgtgtgcctggctgagctcagacaggtgctgtaagaagcttgtttctctaataggcttcctcggggaagcagtggctgcttaaccttggatacacattggaatcacctgaggagctttaaaaactatccaggcccggtctcgctctcccatattctgattcaattgatgtggcaactcaggtgtggggagtttaaaataatcttgccaggtgattcaaaggtgtaggcaaggttgagatgcacgggcctggacaggaaggcggaggtctctgcatggctctggctctgccgatgaccctctgcatgacactgggcaaatccagatactctgccctctctgggcctctactgtagagctgtccagcactgggtcttccctgcagcgtcacaaccagagtcaacacttggcatgggtgctgggtgagtgcttgattaattaaactaaaacaataacttagtagcggtttttttttgttgttgttttttggagatggagtctcgctctgttgcccaggctgaagtgcagtggcatgatctcggctcactgcaacctccgcctcctgggttcaagcgattctccggcctcagcctcctgagtagctgggactacaggtacacgccgccatgcctggatatttgattttgtatttttagtagagatggggtttcaccgtcttgcccaggctggttttgaactcctcatctcaggcaatccgcccaccttggcctctcagagtgctaggattataggcgtgagccaccgcggccggcctagtagtaggttttaagaatagctttattgaggtgtaattgacatacaataaactgcattgattgattgagggtcttgctatgttgctcaggtacctcagcctcccagatagctgggactataggcacataccaccatgctcagctaattttaatttttttttttttttttttaagagatgggggtcttgctatatttcccaggctggtcttgaactcctggcctcaagtgatcctcctgccatggtctcccaaagtgctgggattacaggcatgagccactgcaccttgcccctgcccatacttaagttgtacaatttgatgaattttgatgtatgtatacaaatataaaaccattaccacaatgcaggtgttgatatctgttagtttgcgagggctgccataacaaagtaccacatactgggtggcttaaacaacagaaatttattttctcatagttttttttttttttttttttttttttgagatggagtcttgctccgtcgcccaggctggagtgcagtggcgcaatctcagctcactgcaacctccacctcctgggttcaagcgattctcctgtctcagcctccaaagtagctgggattataggcatgcaccaccatgctcggctaaattttgtatttttagtagagatggggtttcaccatgttggcaggctggtctggaactcttgacctcaggtgatctgcccacctctgcctcccaaggtgctgggattacaggcaggagccaccatgcccgaccatgttttctcatagtttttaaaggctgggaagtctaagatcaaggtgtcagcaggtttggtttcttctgaggcctctccccaggactatcttctccctgtgtccccacatggtcttctctgtgtctatacaggatttgggcccaccccagtgacctcatttttacttaatcacctcttgaaaaatcctgtctccaaatgcaatcacattctgaagtactaggggctgggacttaacatatacattttggcggggttgggggtgggacacagctcagcccataacaatctatcgcttccaaaatttcctggggactctttgtaatccatccttccctccccactccacccccatctctgagcagccactgatttattttctgtcacaagagattagtttgcatttttcttggaattttataaaaatggaatcacacagcatatattcttcttttgtctgacttttttttttcccactcagcgtaattgttttgcgagtcacccacgccgtgggtatcaatagtttgtttctttttgcggctgagcagcattccattgtatggatgtaccacagtttgtttctcactcacctgttgatggacattggggttgtctccaatttttggctattgtgaataaaactgtatgaacattcgtggacattttttaggtatataaggcacatttccacatattgtctcctaattctcgccacaatgctgcaaggcaggcaatctgattctcagactatggatgggcgaactggagcaagacgtggctgtcatgccacataggaaaggattgggtttgtttattgcacatctccagtggccagacagcacgatcttaatagatgtttttcccttgagtgaatgaataaatgagagtgaaggatttgcccaaggttgcccagtggggtctagaaggttggtagcctttctctgtgcacagaacttgtatttagctctgagaaaacagcatcatctctgcaacttcttccagaatgggagccacagcacctgcagttgctttgggtgtgatcaggggtggggtgggacctgccattcaaagcagccttgaggccgaatctcacaggttgatactgttgaatagttcaactgaaaaccgagggaacagaagcctggctgtgctcagatggactctggtcagaacatggcgagggggctttattattctgaaccccagaataggtgagtgatggccagtcaggactgaaacccaagctcctaactcccagctcagaccttggtctcctcaccttctttgactgctgatgcccttctgagcctccaagaactgtgagatgcaagcaggttgtggtgtgtgtgttgctctgcaaaccataacctcctgagcaggcaggggagttgttatgataccttaggtttgggtatttgtgaccacacgattgagctatgattcaagaaacaaaaggaaatcttcacacagaaaaactttcccaggacactgctgacaactgagtccctcttctgctctccctacgccagctggtggccccagcatacagccttatattattggcctcttctgtgggcaccatgcagtaaagaatctagaaacttctctgtacaacttctaatttaatcccttcaacccctatgggagttagcattggtctaattttattgacaatgaaactctggctcaggaaagaaaaggagctcgcccaaagtctcccagctagagagtagcaaagatgcctctggaagccaggattcctgtgtccagctgtacagctgtacagtcagtcctaggacactatttatttttcctaggactttacatgctgttacagccaactcactcctggtcccaaattggggaccctgtgtagtcttccctatcaaacaaatagctggtttctcaggctatttctccgaccctcagcaggcagaagagctggggctctccctcccatccccagggccgtgtaggaggcacagcaccacccgaggggcccagccaagtagacaagaagaaacttcacaacccatgcttgacaacaggagagccacctgccagaggaaggggccttggcacctagtggtcttgttattgggtggggccgctgagtggtagaaattaacaaacagcaattgaggatgggtttggaaactcacaaaccagagagttccaatccaggctctgctgttttgtgtgaccctagagcaccattgttgggcttctgaggctgtgctgcaagcagatgtggccaggctagggccccaggagaagccatcagacagggagcctcagattggactggccctgtcccacaggcaagactgccctgctttgtccaggttggacaccaaaggccaaagttacctagaggagcatgagagttttgtgaggatgggtgtcccaggctgtgttccacacagctgttctggcaccaaaccctctggggtctgcacaggctggaatcctgcccctgctaccgtgtccagaattggttccttccggtgggttcttgatcgccctgacattaagaatgaagccacggcccctcgtggtgagtgttacagttcttaaagatggtgtgtccggagtttgttccttcagatgttcaaatgtgtctggagagtattccttctggtgagatcgtggtcttgcatgacttcaggagtgaagccgcagaccttcacagtgagtgttacagctcttaaaggtggcacttctggagtgtgttcctcctggtgggttcgtggtctcactgacttcagaagtgaagctgcagaccttcacagtgagtgtcctggctcataaaggtagtgtggacccagagtgagcagcagcaagatttattgtgaagagcgaaagaacaaagcttccacagtgtggaagaggaccccagcaggttgttgctgctggctcctgtggccagcttttattcccttatttgaccccacccacatcctgctgattggtccattttacagagtgttgattggtgcgtttttacacagtgctgattggtccatttacaatcctttagctagacacagagcgctgattggtgcgtttttacagagtactgattggtgcgtttataaacctttacacatagagtgctgattggtgcgtttttacagagtgctgattggtgcatttacaatcctctagctagacagaaaagttctccaagtccctgctgggcccaggaagtccagctggcttgacctctcactacctctccaaacaagtctcctgccagctccagtgtctgtgcaggttgtgggatctcctgaagctgggatccctgagctatgtggcaagagcatgccattcctcacctgttcaactcattcctttcccaggatctactggggaccaggagtgagtcctgatgcttggcaaccctgtgcagtttttccagcttcctccccatttagccgaggttctgcaacctccttctgtccactctgaatgcttcccctctggagacttgcttggagtgtgccagtgttccccatgtcctggtctcttggtgggagatgttgttcctggctgtgtctagttggccatgttggctcacctgaatattgactttggacttttgagttgatgctggaataaattaagactttgaggactattgggatagaataaatatattttgcatgtgaggacgacatgaattttggaggctaggggcagaatgctatggtttgattgtgtcctccaaagtttatgttttggaaactgaatcctcaatgcagcagtgttgggaggggggcgcctaatgagaggtgattagatcataagggccctgccctcatgaatgtattaataccattatagtggacatgggttcctgataaaggatgagtttggcccccttcccctcttactctctcactcttgacctctcttgcccttctgcttcccataagatgacacagcacaagggcccttggcagatgccagcaacttgatattgaacttttcagcctccagatctgtgagaagtaaatttattttctttataaattacccagtctgtggtattctgctacagcaacacaaaatagtttgtcaccaaatagtaaacgggacacaaaggacataatcacaaagaagtcaaaatggggacattattgatttaattctttagtgttaaaaaatcaagcttttaaaagagcctttcaatcaagcatattgtgcagttccaaaaacccccgcagggtgagcacagcgcctgctgttccattccgcattacagatctgccgtctgctcgtgtgttcctaggacagtgttgcatgaggagctcagtaaatccctaggtgggcatcagaacacccccaatgggccccacaattctttcttatttggagtgtggcacgtgagctctttgcgactgttcctgtaccccagtcaccaacaaaggccttcacgtggctgatctaaaacatattggatcaaggatgaatggaaggtcctggagccagaggggaattttccttgtcttccagaatgactggggttgctggacttcctgagcccagggactgactggcagggtttgctgacagttggcatgctctatgaagagtagaaaggataattcctctaagccagcctgtgttggggctgtatagagaacagctgctctcaatccatgcctcttatggggtaccttcagcctgtagtcctctgactgatcctctgatcttgttttaggtgccctctgtcccctacattctcattttggctccacatccagttcccatcccaaacctcagttactcactttgatgcttggcttgatctcacccagcttttctccaggatatgacttctagcctctgtactggctacatataccacttctaccagaagctccctcctccccagcacataggatccaggagtcaggacctctttagctagggaagctagttggttttgacttaggtcctgattctagcatttattatttatgtgcacataggcctgctactttgtcttcctgagtttcagtgaaaggaggggaaggccatccctgatggtcacatatggacactgttgagtaagagccagagtcccagacctcagaccccaaagccaacacaggctccagttcccttgatgaagatatttctttccatctcaattgggaatgtctttctcttccaccccatttctttttcaggtaaggatgggccattttcagagctggctttcagtaatgatgacctttctagctgtgtgaccttaggcaagtctcatgtttactgtctatatttcagtttcgtcatctataatatgagaaatacaaaggaacctatctcaggctgtgtaaggtaatacactcacaggttctggggattaggatgtagatatcttcaaggaagtcatgattctgtctacttcaaggcctatctgagcttgctaagttatgtggttccttaaggcctgtggccttctttcattctccatgtctctgccattctctcccatcagctgggtgcctgacagttgacttgtctcaacaaatcttacttgtatctgcttgagtggatagaggtcctttggtatccggcatcttcccaaatggcccaggtgccaggatggcagatctttaaatgatattctttatgggcccagaaaacatatgtattcctctgattagatttggaggccagcccctgtcccttctgagctttgctttctctgctagaagtggctttcattttagatgcttaccagaggctttcgcattgtcagataactgggaatcactatttggatgtcatggtgtacatgtgcagttaggaaccggtacaaccatttgcccctgtgaaagcagcagccccaggataaagccaacatacagagctgggcacaacctaggggatatggagaaatggagcttgcgccctagatcaagctgatcttgaagcccacattaccttccttttacatgagccagtacatttttcttattagttaggccaacttgagttgtgtatgcagctgttatgtatagctgaaagcattacaaatgataaaatgtgaaggagcttgtatatttcctcatggcttcaccatgtgaagattggggattcacgacatgtatttatctcctccccctcctgagacctaactatagaaatgaaaaaggaagaaagtcatgatgatgcagagaatgggaaaagatcattagtgagtaagatagttttttttttttttttaattatactttaagttctagggtatgtgtgcacaatgtgtaggtttgttacataggtatacatgtgccacgttggtttactgcacccattaactcatcatttacattaggtatttctcctaatgctatccctccccctgtccccaatcccatgacaggccccagggtgtgatcttccctgccctgtgtccaagtgttctcattgttcaattcccacctatgaatgagaacatgtggtatttggttttctgtccttgtgatagtttgctcagaataatggtttccagctgcatccatgtccctacaaaggatatgaactcatcttttttatggctgcatagtattccgtggtgtatatgtgccacattttcttaatccagtctctcattgatggacatttgggttggttccaagtctttgctatcgtgaatagtgccgtaataaacatacatgtgcatgtgtctttatagcagcatgatttataatcctttgggtatacacccagtaatgggatccctgggtcaaatgatatttcttagttctagatccttgaggaatcgccacactgtcttccacaatggttgaactagcttacactctagtgaatatgatatttcaagaaagttctggaagaagtaaaggacatggcagatggcacctgaagaagtcactgcttaagtgcataagttctgaagacaccaggtacagtagtgtaagatggagatgcaaggctgaaaatgggcattgtgtgtgtgtgtgtatgtgtgtggcatacacacacaaatatatacacatatatacacattctttccccctaattcagaaaaatcaagcaaagaaatagagggttcttgtaaaattgactggtctcagtgaagtgtcccaaatgtctggcatctggggtaggcagacttatgcattgaacacagtgcctagagccccaattcactcagggcttcccaaaatgttttaattattttaaactcagaaaaaatgagtataataataatgaatatgtaataataaaattgacctggagtatttcatctttataccaactcagtcataaaatataatttaaaataatatttttctcaaggaaggagtacagagagttaaaagtgcctgaggcccagaaacatcataatgtggccctgatctgggaccccctagtatgaggatcactttccaacccatcaccccaaagtgcagcccaccagtcacaagccctatctgtgttcagagagcccaatcagatttttagaaccttgccattaaaaatgaggtgagagcatatcccaatctgtgactgactcgatttgaatagcagttaaaggtgggtgaggctatattaaaagctctaggacccaatcactgcaggattccccttggtgtgtgaaacggactacaaagccaaggtcccattgactactagagaggttgtcaggttagtgcaggtaacctgagtcagaaataactcacatgttcatgcaatagacattcactggactgggcccagcgttgagtaagagatgggtcctgtcttcaggtgtgcccagtcttcttaggggtccaaagacctaaccttataagactgtgtcatcagtgccccaagacaggtgtgtgcctggtgtcatggggctcagatgggggatttgggaaagattcacacatgaggaaatatttgagttgagttttaaaaattgaaacattttgacagatgacaggggtgggaaactttcaggcagaaggaacagtgtgaatggatgctcagaggtgcggaaggccattgtgtgttgaaggaaagacatacggctgaccaaggctgaagtgactatatagtgtaatggccaagtgcatggactgtaattcttccctacctgggttcaaactccagtcctgctatttcttaactgtgtgaatttggcacatttcttaaatcgattttttagctttcccatatgtaaagtggagagaatcataatagtactgttgaagcaaactaaatatggtctgagaaggactccgtgcttctctatttgagtccttgtggatgaactgtagcctagcttagtcagacaagattgagaacctaacttaggagcatgtgcctgtaacaataactgagtcttggccaatcccagggccgtgcttcaaccactcagagggctaagttttcaaactgtgttcaaatgaggcaaacgccaacctggaacccatccagctgtttctgtgcctcactgccgatttctgtacgtcatttcccttttttttgtctataaatcttcttccaccatgtggctgcactggagtctctgtgaatctgctgtgaatctgggggctgcctgatttgcgaatcatttgttgctcagtgaagttcctttaaatttaatttggctgaaggttttcttttatcagtacctacctcaaaggactgttttcaggattatatcctggaataaagtaaatgctctatatgttacctattattgttacccccacccgtttggattgtggaagtttcttctgtctccctgatgggctgtgagctcctcggtggtaggagccacaccttcctcacctctgcctcttccatgggacctaaggccatgtaagtgcttgctaaaggcagattgaattaaatgggcctctgaaagggtgacatatataagcaattatgatttatttttcttctaaagaaggaaatagaaagttcctttcctctgctggtgatgacaaatttgcattgcttaaaaatgctgattggaggaaggcaggccacatttatgggatgtccacagtgtccacatccccagcttcatttactccttcctacaaccagtggagcaaggtttacatacccatttaatagaggggaaaactggggcccacggtcactgagataagtgtgatacagtcagaattcaaacaccttctggcttctagaactctgagaaataaatctttcttgtttataaatcacgaagtctatggtacttggtactttttttttttcttttttgagatgtagtctcactctgttgcccaggctggagtgcagtggcatgatcttggctcatttcagcctccaccttccaggttcaagcgattctcctgcctcagcttcccgtgtagctgggactacaggtgtgtgccaccacacccgactaatttttgtatttttagtagagacgggttttcaccatgttggccaggatggtcttgaactcctgacctgaggtgatctgcctgctttggcctcctaaagtgctgggattacaggcgtgaaccaccacacctggcctatggtactttgttatatcatcctgaactaagactccttccctggaaatttgctcaagctcttgggaatggagggctaaaggaaagagcctggccactcatttgggaggggaaaaatagttgctaacacagacggagggagagacatccctatcccattgaaggtggctgtcctgtgggaagcctgcaattgctgactgtgaccactagatggaagcatggagaacagtgccggttacagtctgggtggaatttgacctgtgctccccaagcaggagctgtgcctgggcttccatggatgctccagagaaaaagccccaagctggcctggcctcgcagcgtgtgggctgctgcatggaacaggagtagtcagttggtcctatgttcccagctcagggactggcctcaagattcactgggctgaatgctggggttccattacccttttggatttcatggctcctggcttccctctgctcactgtcgccaccactgggctcagtccatccatggggaacatctattagtggagaagggccaagtaatttatttttttggatatgtgtgtccacactgcttggaaacaaaattgtagcttcctgtactggccagattctctgtccttggccctccacagtggctcgtccctggtcagggtcccaagcggccacccccgatcacctagagtttggcaactcttggaagactagagcaatggtctggtcttgataatttcatcacataaaagggcagggaacacattgcaacaaagttcactccctgcttcattcccagaataatgtgtctgtaaatgaattagaagtggatttgacacgtattttcaatgaaaaggtcaaagacattacaactgaaaacactcctctctgtgtagacaggcctgctagtgtgtcacaaggctctcaaggagagagggggaaagactaatgcccatgggccatgcaggtggcaggggcttcgtctactgtctctctgtgaagtggacattctaattattatttctaccttacagtggaaagtgtggctcagagagtgtatttgttatctattgctgtataacaaattacttcaaaacttagtcgcttgaaataataagcatgtagtttctgagtgtcaggaatctgggagtggcctagctgggtggtgctaattttaggtatctcgaggttgcactcaagatgttggtttgggctgcagtcatctgaaggcttgactggggctggatactctgctttcaagatgacacactcacatggctgttggaaggaggcctcagttctgcatcatgcagtactggtgaggcctccacaggaggcctgagtgtcagtttagcatggcggttggcttttacaagggctagtgatccaagggagaaggcgaagacacatgcctttttatgaactagcctcagaaactacacatcatcacttctgtcatattctattggtcgtgcagaccaaccatgatgcagggtgggatgggactccagaagggtgtgcagattggtagacaaggatctttgggggctatcctggagaccggctgctaccagagagcttaagtaacttggctatcaaatagactgaaattcacttaaagttcccactgttcttttgtagtaggggcagaggccttggagagacattcggataggtgaaagaatcaagaactcatgctttgcccactctactgaaaaaattaaaaaatgctgataatactatttctcaggatatggggaaatggacactttcattcactgttcaaaatttaaatttttctttattttgactctaccactcttcctttaagactctatcctatagaaatatctacattcgcacatatatgcaacatatatacatatataacttttttaaaaaaaaccagaagtatcatttattatagggaacaattggagataaatctgggattgattaaataaaaattatatgtcattctagtgaaatatctgatagccatggaaaagaataaggcagatatatatggaaagattgttgagtgaatatagcatgttatagaactatatagagacatagtaggattccatttatgtatatgcatataagacatatacatatatgtatgtatttttattgttactataaatataaaaaaaaaaaccaaaccattagccatggttacttgtaggaggtgggactttgggaggggcatgtgtactttacactcttgtctgtagtttaaattatttccataggttcttttcacatctaaataacttgataaaattaacattgatacaacattatctacagacattgtttgaatgtatccagtttttccagtaatgttctttttttctggtgcaggatcagcgctctccattgcattagctatgtcttcctggtcttctctaatctgtaagaggttgtcagatttttatttgtgactttcattacctgacacttttgaagagtactggtcagttactttgtagcatggccctcaatttggatttgtcaggtgttttttcatggttagattgagattatgcattgtggcaagaatatcacagaagggacgtattgctcttctcagggcatcgcatcactgatgttgatatatcttattacctgtgatattaatgttgatctcttggtaaaggtgctgtctgccaggtttcttcaccattaagttcctatttctccatttgtatttaataagtatcttgtttgtaacaattacatggtggtgtttgcctgatggtgattttctatttccattattccttgtatttattagttagtgttcttctgtaaggatgagctgtccctatccaccaatttaattattcagtgatttatatttatgtcagtatggaaaatagcatattaaaatatgttctttataaaattaatataaactaaaaatcttgaatgtcgagttaccatttttcagaaagaacaaataatttttggtgaaaggatcccctgtcatgcagggcagagagagcagagctttcaggaagaagcccagtcttgggaccataatagaatttgagcctgcttgcagcatagagatccttaatttcatttcacagatgatgaaatggctcagagaagttgaattggcaaatcatgctgtagccaggcttaggatctatgtctgtttgattctaagactcacgtgcattccaccatcctctttcaaacatcaggagggggtgaactttaaggtccctttcaagtctgaatttctacacctatgaagtctcccaaccatgtggacctgtgacctcatcttcccttccttaggggactccagccagagacttactgccctgggggagcctcagttgctgttctacagacccagcttgtcagaacctcaaagataaggcttttaaagaacctttcagctcttccccaactaagcatgactccatacaactgcggttctcatctgcacataatttaattcctcttcagcacaaagagatggtaaatcagttgtgcatgtgtatgtgtgtgaatgtgtgtgtgtgcacgtgtgcatgtatggatatatatgtgcgtattgtgtgtggggggtagtgaaagggaaccagataaccacacttaacactgggggtcagttcaaattgttcccagcaatcaactcccagcaggcttgtcaatgcaatgcttgaaggctttcgttctgagtttcctggaagagaattgagacttttagtttttagcttacccatcataaaagaagctctattcgactccttgttctacatcacacacaccacccctgtgtccttcctagcactttttccagggcactagtatctcagtaattatttgagttatgttgcctcccctactagactatatgcactatagcagacagcgaccatatttgttttcctcattgtggtacacccagtgccttgtatagggccttgcacataacaggcactcaataaatatttgttaaataaacgaacaaatcatttagttcaaaaaatcagtgtttcctttgatgggcaagaaaggcatgcttgtgtagtggaaggcctgtgaaaagcatagtttttccttaatctgcacctgtgtattgcatgttagttagctcagcaaatgtacattttctctgggaaacttctgaaaacacaaaggttacatgccattgaatccgtgctgaatttggtgattgattttatgtttttttgatctttataaaggttgggcagtggatcaggttgttaaatagcaaagcagatatccttgttaagatatccaaaggtgtcaattctcagaaactgggtttacacacccagtgaagggcagacacagcccggtggtgttctccaaagagccacaagatggtgctgctgttgctccccaggcctggcctttttgctcacgcctgtagccgctggaataattacagtaaaaagctctttataagttagaagtgattgcccgatagaaactctgctcgaattttggctaatgatggagacttctcacaatgaatgcttttgaagaaggcctcagtgaaagccttgcattcttggtgtattttccaaaggcaccaattgagagaaggaaaaatggctggaaatggcagcctcctccccaagaaccaccagcagacagtgagccctccagcagcaaggctggattgattggctgttctctcaggcataactctgtctccagtggcattttccctcctggccctttgaatcctctcccacggatccaagttgtctgttagcagttgtatcattgagctgggttctgttctagctgcttgaagtctctgatttaattgtaatgggctaggcatgcatttgttcactcattcctccattcattcattatgcatccagtacttgctgtgtgccagatactgtgctagaaactaggaaagcaactgcaaataaggcagccaaagatttggacttgagttttcccccgacctctgctctaccctgatccagcctgattctggccagccctcgcccatggtggagggactccttttccctctgcctcattttcctattgggtctatgcctgggtcttgtacagtttgatgatctgaactgtagctttaatactgactctgagagaatgcctaggagccctgcctgtcctggacaccttatctgctggacaaagaaactgatctgagtttgggtgactaaccaaacctgttttcttggtactgagaggagagatagtcatgggatgcagaactttcagttttaagaaaagtactgatgagtttcccaggatgtgagactttcagtgctaaaacctgaaaagtcctgggcaaattggggtgggtttgtcaccataggtcagcttccccaccacactcctgacaggcctggcctccttgcctctctccacccagtgtttctgaggtccaagctactagactgagaggctaattattaatataacccctgcctgtcctgtgctttctggtcaccttaggggtgactagcaggatgcctggggaggacggggggagcatgtcttagcatgagcaatgaccttgaacaagtcacttaacctctcagcctccatttcttttattgtaaataggtataattatccctgtctcagatttcttgagaggattaagtgagttcatgcatataaagtatcaggtataaacctaaacatgtgggcacagccagatgtcgatgatatagtgagtgaaaaaagcaatggcagaaagatacatggaagtaagtctgcagctgcaatctggagtgcagagcacagggcaggttggggtagggtggtggggagtgtggctgggcctggcaagaggtgagactgaaaaggcagtcaggggccagttcccggaaggccttgaaagcctctctgaggcttttagattttactctgattgcagtagaagttgctgagggattttaggcagaggaatgaccagataggtttgggttttagaaagatgccatttcctactcatggctgttgtgtggatataatggtggtcactcagtagctgccaaaaaatatccccctttttcttattattgtatttttccccttacagtctccctggtccctttacctcatttatgtattcagcaaatctctttattaaaaagttcaacttttattttagattcaaatggtacatgtgcaggtgttacatgggtatattgtgtgatgctgaggtttggggtacaattgatcccatcatccaggtagtgagcatagtaccggacaagaggcttttcagcccctgccccctccctccctgcccccttttggaatccgtagtgtctattgttccaatctttgtgtccatgtgtacctagtgtttagctcccacttatgagtgggaacatgcggtatttggttttctgttcccatgttcgttcgcttagcataatggcctccagctgcaaccacgttgctgaagggacatgattttgttctttttttatggctgtatagtattccatggtgtatttgtgccacattttctttatccaatccaccgtggatgggcacctaggttgattccacgtctttgctattgtgaatagtgtcgtgatgaatacgagagggcatgtgtctttttggtagaatgatttattttcctttggatatataccggtactgggattgctgggttgaacgatagttctgagttctttgggaaacatctgaactgctttccacagtggctgaactaatttacattcccagcaactgtgtataaacattccatttttcccatagcctcaccagcatctgtaattttttggctttttagtaatagccattctgacggatatgagatggtatcttatagtggttttgatttgcatctctctggtgattagtaatgtggagcatttttttcatatgtttgttggccatttgtatgtcttcttttcaaaagtgtctgttcatgtcctttgcctattttttgatggggttgttttttgcttgctgatttaggtttcttacagagtctcaatattagatctttgtcagatgcatagtttgtggctattttctctcattctataggttgtctgtttaccttgttggtagtttcttttgctgtgcagatgctgtttagcttcatagggcccacttgtcagtttttgttttgttgagattgatttttgaggtcttagctataaattctttgccatgagcgatgtccagaatggtatttctcaggttttcttataggatttttatagcttgaggtcttatatttaaatctttgatccatcttgaattaatttttgtatatggtaaaaagtaggggtccagtttcattcttctgcatatgattagccagttatcccagcagcatttattgaatatagagtcctttctccattgcttgtttttgttgacttcatcgaagatcagatggttgcaggtgtgtggctttatttctgagttctctgttctgttccttgggtctatgtgtctgtttttgtacaagtaccatgctgttttggttactgtagccttataatacagtttgaagtcacataatgtgatgtctctgactttgttctttttgggtaggattgctttggctaattgggctttttaaagagtagttttttttctttctgtgaaacattatgttggtggtttgttaggaatagtgttgaatctgtagattgctttgggcagtattttaataatagtgattcttccaatccgtgaacatggaatgtttttccatttgtttgtatgatttctttcttcctcttccccttccttcctccttccccttccttccccttcctgccttccttccttcctttgaaacagggtctcactctgtcactcaggctggagtgcagtggcacaatcttggctcactgtaacctctgccttccaggctcaagcgatcctcccacctcagcctcctgagtagctggaactacaggggcataccatcacgcccatctaatttttgtacttttttgtagagatggaatcttgtcatggttgtctaggctggtctcgaattcttgggctcaagtaatccaccagccttggtctcccaaactgctaggactacaggcatgagccactgcacctggcccatctatgatttctttcagaagtgttttgcagttctccttatagcgctctttcacttccttgcttagatgttttcctaggtgtgtgtgtgtgtttatattttttttatggctattgtacatggaattcttgatttggctctcagcttgagtgttactggtatatagaaatgctattgatttttgatttttgtaccctgaaactttactgaagttgtttatcagttttaggaggcttttggcagaatatttagggttttctaggtatagaattatattgtcagtgaagagattttttaattttttaatttttttttgagatggagcctcactctgtcagccaggctgcagagcagtggtgcgatctcagctcactgcaatctccacctccccagttcaagtgattctcctgtctcagcctcctaagtagctgggattacaggtgcgcgacaccatgcctggctaatttttgtatttttagtagagatggggtttcaccatgttgaccaggctggtctcgaactcctgacatcgtgatctgtccacctcggcctcccaaagtgcgggattacaggtgtgagccactgtgcctggccaaaaagagatgatttgacttcctcttttcctatttgggtgccttttatttctttctcctgcttgattgctctggctagaacttctaatacagtgttgaataggagtggtgaaagttgacatccttgtggtgttctagttcttaaggagaatgcttccagcttttgcccattcagaatgatgttggttatgggtttcacagatggctcttactattttgaaatatgttcctttgatgcctagtttgttgagagcttttatcatgaaaagatgttgaattttattgaaaggtttctctgcatctattgagataatcatatggttttgtttaggttctgtttatgtgctgaatcacatttaaagatttgtgtatgttgaaccaaccttgcatcccaggaataaagcgtacttgatcatggtgaattaactttttgatgtgctgttggattcaatttgcttgtattttgttgaggatttggtctctatgttcatcagggatattggcctgtagttttctttttttgttgtgtctttaccagatttcggtatctgggtaatactagcttagcagaatgaatgagggaagagtccctctttctcagtttcttagaagagttttggtagagttggtaccaactcttctttgtacatttggtagaatttggcagtgaatctgtctaatccaggttttttttttttttttttttttttttttttttttttgagagggtgtctccctctgtcccccaggctggagtgcagtggtgcgatctccgctaactgcaagctccgcctcccaggttcacgccattctcctgcctcagcctcacgagtagctgggactacaggtgcccgccaccaagcctggctaattttttttttttgtatttttagtagagacggggtttcaccatgttaaacaggatggtctcgatctcctgacctcgtgatccgcctgcctcagcctcccaaagtgctgagatgacagacgtgagccacgacgcctggcctccagggtgttttttagtgggtaggtttaaaaaaaaattactgattcaattttggaacttagcattggtctgttcaatgtttcggtttcttcctgagtcaattttgggaagttgcatgtgtcaaggaaattatctacttcctctagattttctagtttgtgtgcatataggtgttcgtagtagtctttgagaatcttttgtatttctgtgagattgtaatgccagtcttgttatttctgattgtgggtgtttgggtcatctttctgttttcctttgttagtctagctagtggtcttctgatcttgtgtgtcctttcaaagaaccaacttttggttttgttgattttttttgtatggacttctggatctcaattttgttcagttctgctctgatttcagtcatttcttttcttctgctggctttggggttaatttgttcttgtttttctaatttctctagttgtaatgttagttgatttgagagctttctaatgtcttaatgtaggcatttagcattataagtttttctcttaacactgcttttgctgtgtccaagagattttggtatgttatatctctatttttatttatttcaaaaagaattttttgatttctgccttaattttgttgtttacccaaaagctgttcaagagcaagttgctcaatttttgtgtagttgtgtgaatttggaagatcttcttggtattgatacctatttttattccactgttgtctgagagtatgcttggtatgattttgatatttttgaatttattgagacttgctttatggccaagtatatggttgatttagagtatgtcccatgtgcaaatgagaaggatgtatattctgtggttgatgggtggagtgttctgtagatgtccattaggtccaattggtcaagggtcaaatttaagtccagaatttccttgttagttttttgcctcagtgatctgtctaatgctgtcagtgggatttttgaagtcccccactattaatgtgtgactgcctaagtcttttcgtaggtctaaaagcactcattttatgaatctggttgttgggtgcatatgtatttaggatagttaagtcttcatgttgaactgaactctttatcagtatgtaatgcccttctttgtccttttttttgctgttgctggcttaacgtctgttttatctgatatctgatatatccatctctttcctttgagcctatgggtatcattacatgtgagacggatctcttgaagacagcagatggatggatctcatttttttaaatccaccttgccactctgtgctttttatatggggtatttagaccatttgcattcaaggttagtattcatactgaggaatcgatcctattgtaaagttgttaatgtgttgttttgtagtttccattgagtagttgctttatagagtctgtgggctctgtacttaagtgtgtttctgtggtagcaggttttgttctttcttttacatgtttagaacccacttaaggatctcttgtaaggctggtctagtagtaatgaatttccttagcacttgcttgtccgaggaagattttatttttccttttagttatgaagtttagtttggtgggtatgaaattcttggttggagtttcttttctttaataatgcttaaaataggcccctaatgtcttctggcttatagggtttctgctgagaagtctgctgttagcctgatggagttccctttgtatgtgatctgactttttccgtagctgcctttaagatttttttcttaagattgaacagtctggtgactatatgccttggtgatgctcattttgtatagtatcttgcaaatgttctctggatttcttgtacctgaatacctacatctctaacaagattagggacattttcatgaattactccttcaagtatgttttctgggttgttacctttttctccttctccctcaggaatgccaataatttataggtttagtcattttatacaaccccatacatcttgaagactttgttcattttaaaaaactctttttgtgtattctctttttcatttaaaaaaattcctgggttagctcaaaggaccaggcttcaagctctgaaattctttcttctgtttgatctagtctattgacagagttttcagttgtgttttgatattccttaactgaatttttcaactccagaagctctgattaatttcttttaagatgtttatctcttccttcatttccaggattgttttacaggtttctttacattgattttaaacctcatcttgaaaatcattgagttttattgtaatctatgctttgaattttttatctgacacttctgggtttcaattttggttgtggactattgctagagagctagtgtgatccttcggtggtatcacaacatgcagatttttcacggtgccagaattcttatgctggttccttctcatttggagatgctggcacttctaatttttgtaataattttcgtgatgataggctctccccctttttctttccctatattactattgtttttttttctttccctttctcccaccttgctagagggtatgactgtagggcatgttggatagggtttttttggctttgcttctatggtcctatgcacttccaccagtaggttttatactggactgtgcatttcagcatgtgggccaatagatggcacttatgggtgagagctagcatggtgcaagcagatgggtatgtacctgatctttgattactgtgagatgctctctgttgttttaggtgatgggctggaccacagagtgctccttgccatgtgcttcctcttccatggggtagggtgacacagctaggcagagctggagccctggcttgcccaataatatccccgtgttgaatgtaggtaccttccttgatgagggtggctgggaggagctcctagtgaaatgagctgaggtctctgcatgggggtggggtggggggctgcaccagcccctcatccttgataggcaggaatgtggactgctcttctgtctcactcctgttccggagctcatgactcctaaatcagatgcacatcatagcctatctctggaccacagtgtggttgagagccttggggattgactaatttgtgattgtctgtgggagtggttttggggcagaacttcatcactcaacctaatgctctgtggctcccctcttctccaatgtgatagtgctacttctttgtggaagaggatggggagctctgtctttgggcctgtgcaggggtttgttggtggtggtggcattggctggttaggccagtctaacctcaggctctgggggaaaggtcaggtgccagcagatctggaatggattaggtagttctctaactccctggcccccagatggctgggtggacagagtgtataagtcctgatggggctgggggctcaggtactggctgtgatgggaaggattgggccagtccccaggtcactagctgaactctcagttggtgtgagacagggtgcttaggtggtgggagcttgagggaagctcataggttgtgggggtagggttttaagtaggcctctgggccaaagctgaaatgctcatgcagggcagcgtgggtgcactagaagccagaaggcagcaagccccatttgggagagggcagggaaggtggggggatcatgaggaaagaatctggctgcttctgtagggcagctgctggtgtgctggaggctccagtaaaggcaatcatgctttttgttctctccccagcctgtggggaagtaagagtggggatcccagtgccaggtcgatggctgagggccagtcagttgcctctgggagctccaccctagagaagcacagagccgtggcagataggagtgatcaagcaggggtgggtggctgtgctgcaggcccaaactgggagaccctgcctggtgaggagcagtaagggcatgggatcgcccggaaaacagtctggcctcttctctgtaggggagctgcagcaagctggaggccacaatagctctctggctctttgctccctccccagcctaaaggcagtacagcaggcctgtagggttacctctgggagctgcttcccagagaaatgcagagccatgactggccagagtgctcaggcaggagtagggtggctgtgctggcgacccaggccagtgggccttgcctggtgaggagcaggaaaggtagggcctacagtcctgctgctcctcagcaccgtggaggtggtccctaacctagggcttgtgaaaaagccagtccttcctggttggaggggctatggcagctggtgtcagggtattcagggatccaagacccctggggcttcacatgggcttgagcagtggctctgcccagactccaggtggctctctgtgttcacctggagccctggggaggtcatgggagatctccagtgcacaggattgcagaggtctgtggtggaagtgtgggtccctggggggctcttgctcactcaccctttcccgcagtagggagcttcccatggctctgtgttgatctcaggtgggtggctgccctactttactcttctctgctctctgtgagtcttgatgcctccttgatgaatcccaacgtgacctcctggacgatccatgtgaagagctagtgttcaacgccactttgtctcctctctgtgagagtggtgtgtactaacttcttctagccagccatctcaagttctccctagcaaatctctatgaacacacaatcatttaggactgcagttgaactcctagcctgcctctgatagagccaacccaaggctggtctataagatactgacagccctggtcccctgggtctcccaggctgcctgcagatgacacagtgatagggccagtgggggttgagggagtgacccagactggggactggcttccttgcctccctgagctgccatttccttacatctggtgaactctgagcatgcgccttgatgaacactgctctaagactttagaaccctccctggcttctgagtcttgcttttctagattcttgatgctgattcctactctgggaattgccacggggaccaggcctggggactggggaagagtggcagcaccagccttgccgagggtcatggctaccctgggaattcttctctgggcagagtccaggggcttgtaccctgtccctggtaccacttaactgttggcagcaaaccctctctccaccttttaagctggcaggactcgctcatgaatgctttgcctgcgggcccataatcagataaaagcatcagtgagatttgtggcctgtgttcagcccctcccctgctccttccctgctctgacccagctctattccctccacttgttctgtatttccatgggccggacttcatccacagttcaggtgttgacagtcattgcccttgcactttaacccacagagtctgacttcttttattattcctgttgtcttggtagaagttgctgcccaagacctgtctttaaaaattgctgttctggtggctcatggtcacccaggacagccagactcttgtgagggatgtgtgtatgagtgttgggtgaggaaggggcttgggtgaacacaataggacttcgtagaagcaaaatcaaggttgggccaggtcagtatgaggggtcctgacctctgataatcagcccacaaggtggaagctatgggggtcctaacagaacttacccaactgagccactcctagggcgccagaaacgccatgtttaggattcagccaagttgggagccagagatgtggctgtcaaaggtgagagtaggtggctagttaaaggtgacactgggaaattttgtcaaatgttttattggttcagcagcatctttgcccttaaagatgatgcttgggggacaatggatggtgacagctttaaaatccttctacctaacttgcctgcaaataactgaaaattcagtatccttgtcttgtgcgcctaatgagagagttgtagcctcggtggggagcggtcccaccacaactaaaagactgagctataacatggcagctgactgaggctgctgggaagggcagcaggggtcagcataactgagaatagggatgaccaccaagaagagcatgagagccaccgtcagggtcctcccaggggaggggagggaccctggagctgcctaagacagaaggaaaaagagaatggataaccacacagaagagacaaggcttgctcttcccacagaagcgccgcctgctagtcgtggctaccccacaccaggcagcctgcaacccctgtatgggctgcagctggacggagctgctgtggacatatctctattgaactgctgctctgccattgcagacacagagggttatgcatcatagggaaagcatggagaagtaagtgtgggcccctctgacttccacggatgaggctgattaatctcataagtagaaaaagccttgcattttgtcatctgtaaagtctttaaaaaaaatccttgttctgaaaataaagtgaaataaacacatacagtgtatgtggtacagggtctgactcacagtgagtgctctggtttcagacacactgagctcacgactccaatatttgtttgataaaccttggccttggaatcatctgctgggcagagcccaccaagctgcccctctgccctgtcctgcacagcatggcaaactcagtctctaaactcatgaacattcatggatgtgccactgctagtaataaatggcaatagtgcacattcatggggcattgtgtagtgtgtttatatctgctatggtgtgaatgcatcccccaaattaatgtgttggaagcttaatcctcagtgcaacagtgttgggggctcaggcctcatgggagggctctttaggtcataaggcttctgcctcatgaatggattaatgctgctatgaaaagagcttgcaggagtgagtttgttctcttctgcttttttgccatgtgaggacacagcattcatctcctttttgtcctttcaccttctcctatgtgagcacatagcaagaaggccctcaccagacaccagatgctggtgtcttgatcttggacttggcagcctccaggactgtgagaaagccatttctcttctttataagttacccagcctcaggcgttctgttatagcagcacaaacggattaagacaacatccattactctaatttaagctgcagcaaatttttgctcaaacaaagatagaagttataggttaactagaaacaaacccacttttataatctttacaataacagtattgaaaattatcctcattttatagataaggaaacatttatccaacaatgaaacggagtgtcttctgatacttccccttttctctttgtttctctaagaaccatgttctttattcattgccactgtccatgttagttctcatttggagaattgctacagtctcttttttgttctcactgcctcaaagttccctcctccatcctactgttcactgcaattgctccaagactaaaaagtaatcatgctacgcctctgcttaaaagtgaaaattaggccgggcatcgtggctcacacctgtaataccagtggcttgggaggctaaggtgagaggattgctggaggccaggagtttgagaccagcctgggcaacatagtgacgctctgtccctataaaaaatagaaaaatttagctgggtgtagtgtgtgcacctgtagtcctggctactcaggaggctgaggcaggaggattgcttgagcccaaaagtttgaggttacagtgaactaccattgtgccactgcacttcagactggacaacagagtgagaccctgtctccaatttaaaaaaaaaaaaggtgcaaagcagtcccagttgtcccctggatagagtccacattctttagtgtgatgcccaagactgtcctttgtctgatacatgtcaacttttccagaattatttctcatcacaccttgccctgaacgccactaacattctttcatatatgccagggtagactttgctcagcctgagcctatactggtttatctatttaattttttatatttttagaaataagaactcttggagcttttgaaaaataacaaactgagctccattttcaaattaattaatttctgttatcttcagttattccttctgttccctctagttaggattacttgattgttttaacaccccgttctgctccccactccaggtgggctcagcccccttggcaatagtgagggtagggagaatattcaagcagaagtttttcttgcttattttgatcctaggctttgttttcttggtgcgtggttacctttatgtacccacattgactagtagaactgtcaaagctgggtgtatgtgaatttttacctgcactgactgatgacaggagagtccatagggtagaagttagtctgtagcaccccacaagttttgaaacctaccaagttggtttcatactttataagacctgaaatcctctttttttgattttctttttaaaataattccatttaggtcccttcctgtatttcttctgcaatttttctatttccacctacacggaaccatataaaaccatattaagtaggcatttcctgttgtttcttcagtcattctactttaaaatgagggtcgttgtcttagacaaccttgtttgtagtcctaggcaatcttgtttggtacctgagggataatcatgagaaaatgacaaatcttacagtaatatacatatttgtacaagtgtgcaaagatgtatgagtaagaatatttattgcagcagtgtttgtaatatccaaaattgtaaacaactgaaatgtcagtcgagagggagcttgttaaatgcatgtgattacagccatacaactgaatatcatgtttccattgagagaagcctatatgtaccaatatggagggttaccatttatatgcttaggtgaaaagaacaaattttatgtaaagtacaaaagtatgattccatttctgttaaaaagagattattatatacatatatacccttcatagcctggaaagtttttaaaggaatattcgccaaattgtaaaattagttaaggtattggttgaggggtggttgtagtagggaatggaattacagaagagaggacttcataatctaatttatatattcctgaatatttacttttatctttacaaaaacaatgtgttacttttataatcaggaaaaaagctttaaaatgtatatcttctgagatgcaactacagcaattataagtggaaaatttattgcctctaatgctagaatttctaaacagaaagaatgaacatgaacttatcgataaataaaatatgagtagatttcacactggtttaggaataaatggacataagtaaaaagtaatcaaagcacaattaaatagaacaaatacagggacacagattaattttgacaccagctggagccagcaacacatctagcaaatctagcatctatctagttatgcttctgtgaaaaacatggtttgcaaaacctttgaaaggagcaaccaggtcttataactggtggagcatgtagctcagtgcggttttgatttctgatttttgtttgaaacaaaagttgttcaggagacaggatgtttcttactaattaggcttcctttttttgtttgtgtcaacttttgtgccattttttgttactcaattttatggtatttttgaagaatgtgttatgtgctatttctttttttctcctttatttttaaatttcaatagtttttggggacaggtggttcctggttacatggataagttctttagtggtaatttctgagattttggtgcagtcatcacccgagcagtgtccactgtacccatgtgtagtcttttatcccttacctccctcttgcccttccgcctgagtccccaaagttcatcacatcattcttacgcctttgtgtcctcaaacttagcttccacttataattgagaacatacagttttggttttccattcctgagttacttagaatcatggtctccaactttatccactttgttgtgaatgccattatttccttctttttatggctgactagtatcccatggtatatagataccatattttaaaaatctactcattggttgttgggcatttaagctcgttccatatttttgcaattacgaattgtgctgttataaccatgtatgtgcaagtgtctttttcatataatgatttcttttcctctggatagatactgagtagtgggattgcgggatcaaatggtagttctacttttagtcctctaaggaatctccatactggtgtggatttagtaagttttctttagaattaacttctgtaaacaatctatggggccttaaaatgtatgcttgtttttgagcatatattttgagcatacattttgaaggtgtagagtttgaaatttatctattggatagaccttataaattttattaatcaggtcctgtgcagttttgattatttttagtccccttgatctgtcctgggataagaactgtgagtcttttttttttttttttaagttctccttgtatttacaacagtttctgtattacatattttgatgacacatgctacttagtgcttgaacgttcaaagtatctatgttttcatcatgcagtactatttttattataattggccccattcttccagtttaatatctttttttgttttttttgagacagagccttgctctgtcacccaggctggagtgcagtggtgcagtcttggctcagtgcaacctctgcctcctgggttcaagcaatttctactgcctcagcctcgtgagtagctgggactataggcacacgccgccacacctggctaattttttgtattttagggtttcatcgtgttgtccaggctggtctcgaactcctgagctcaggcagtctgcctgtcttggcctcccaaagtactaggattacaggcataagccaccatgcccggccttatctttttactttgaattcaaatttgatattatcacaaaaacattgattgcttctttctttttctttctttcttttcattctcttttctttctttctcttttctttctttcttttctctctctttctctctctctctcttcctctctttcttcctttcttcctctctttctttctctccttctttccttctctctcactctttctcactctgtcacccaggctggaatgcagtggcccgatcatggctcactgcagcctcgacctcctgggctcaagagatggtcccacctcagctttccaagcagctaggactacaggcatgtgccaccacacccggctaatttgtgtattttttgtagagatggggtttcaccgtgttgcccaggctgatcttgaactcctgggctcaagcgatctgcttgcctctgcctcccaaagtgctgggattacaggtgtgagccactgcacccagccaatttcttttttatataacaattgtattgggatataattcacctaccatataatctaccagtttaaagtgtacagttccatgagttttagtatactcagagagttgtgcaaccatcaccacaataaattgtggagcattttcatcatgtcaacaagaaaactacccaccagcagtcactccccatatttattccaatctcctgagccctaggcagtcaccaatctactctcatgtctatagattggcctattctggacatttcatatcaatggaatgatataatatgtggtcttttgtgactggcttcttttatttaggatgttttcaaggtatataaatgttacatccatgaagtaacagtgcttcattccattttattatggaacaatattacattatatgggtataccacattttatttattcatcacttgatagacatttgagttgtttctactttttgctattatccttgctatgctcatccatgtacaatttttttgtgtggtcatgttttcgtttctcttgagtatatacctatctttacaaaaataatgtgttatttttataatcaggaaaaaagctttaaaatgtgtgtcttctgggatgcaactacagcaaatgtgggtggaaaatttattgcctttaatgctagaatttctaaacagaaagaatgaaaatgaacttctagacatatagaattgctgggtcacgtggtaactgtctaaacttttgaggaactgccatgctgttttattgtcttctgttttccaaagtgggtacaacattttacaccagcagtgtatgaggattccaatgtgtgcacctcctcaccaatacttattatctgtatttttgattatggaccatatagtgggtgtgaagtagtatctcattgtgttttgacttgcatttcccctgacagctactgatggagttttcacaatataaattttgtaattcttttgttaaatatcccctcaaatattttattcttattgatgccattataaatagaattgtttgcttagttttcctttttgggttgttcattgctaatgtataaaaatacaattgatttttgttttcatttttgtttgacttccaacatttattttaagttcaggggtacctgtgtgggatgtacaggtttgttacataggtaaatgtgtgccatgctagtttgctgcatatatcatcccttcagctaggtgttaagcccagcattcactagctgttcttcctgatgctctcctctgacaggccccagtgattgttgttcacccctatgtgtccatgtgttatcattcagctcctacttattagtgagaacatgcagtatttgattttctcttcctgtgttagtttgcagctccatctatgtccctgcaaaggacatgatcttgttcctttttatggctgcatagtattccatggtgtctatgtacgacattttctttattcagtctataattgattggcatttaggttgatttcatgtatttgctattgtaaatagtactgcagtgaacatacacttgcgtgtctctttataatagaatgatttatattcctttggatatatacccagtaatgggattgctgggtcaaatgatatttctgcctctaggtctttgaggaattgccacactctcttccacaatggttggactaattaacacttccaccaacagtgtagaagcattcctttttctccacaaccttgccaacatctgttttttttttttttttttgactttttaataatggccatactgactggtgtgagatggtatctcattgagattttgatttgcatttctctgatgatcagtgatgttgagctttttttcatgtgtttgttagatgcatgtatgtcttcttttgagaagtgtcttttcatgttgttttcctacttttaatggggttgtttttttcttgtaaatttgtttaagttttttgtagatgctggatgttagacctttgtcagatgatggattgcaaatagattgtttactgtgatgatagtgtcttttgctgtgcagaagctctttagtttaattagatcccatttgtcaatttttgcttttgttgcaattgcttttggcatctttgtcattaatttttttcccatgcctatgtcctgaatggtattgcctaagttttcctctaggatttttataattttgggttttacatttaatctttaatccatcttgagttgatttttgtatatgtttaaggaaggggtccagtttcaattttctgcatttattatatagggaaccctttcccattgcttgtttttgtcaggtttgtgaaaaatcagatggttgtaggtgtgtggtcttatttctgggtactctattctgttccattggtctgtgtgtctgttttggtaccagtaccatgctgttttggtttctgtaggcttgtgtagttttaagttaggtagtatgatgcctctggctttgttctttttgcttaggatcatcttggctattcaggctcttttttggttccatatgaattttaaaatagttttttctaattctgtgaagaatgtcaattgtagtttaatgggaatagcattgaatctataaatacaattgatttttgtatattgattttatatcctcaaacctcgctaaacatttattagttcaaattatttttcagtggttttcttagaattttctgtatataagattctttcatcttaaatagagataatttacttattttctaatcgggatgccttttttttctttttcttgcctaattggtcttgctagaacctccagtacaatgttaaatataagtgaacatccttgtcttgttcctgatcttagggggaaagtatttagtctttcattatttactatgatgctggctatgagtttttcatagatgccctttatgaagttgagaaaattctcttctatttcttgtttatgaagtatatttattttgataaatatttgatttccctccatctcttgaggtgatcatttggtttttgtcccttattgatatggtaccttacattaattgatcttcagatgctaagccaaccttgtgtttctgagataattgtactttgtcatggtaatatgatcctttttatatattgctggattaagtttgctagtgtttttttgagcatgttctgtgtctatattcattagagcaattggcctatagttttcttttcttatgatatcttcatctggtttgggcatcagggtaatgctggcctcatagaatgagttgggaaatgttacctcctcttctaatttttgaaggagtttgtgaagaaatggttttacttattttttaaatgtttggtagaatttaccagtaaagtcatgtgggcctgggcttttcttcgtgacatgtttttaacttacgaattcagtcttttgacttgttatatatctactcaaactttctatttcttcttgagtaagttttaatagtttgtctgtttcatataagttatctaatatgttggcatacatttgttcacaatactaccatgtaatcctttttcttcctgtaaggccattagtaatgtctcttgtttcattcttgattttagtaacttgagtctttctctttctctcttctatttttaactaacagtttgtcagttttgttcatcttttcaaataatcaacttttgcttttgttgatcgtcttttaaaatttgctctttcactaatttctacgtaacctttagtacttccttctacttgctttgggcttagttttctctactgttttttgtttacaatttttacctgagagctctcccttaatgagaaatttgcactcaaatgcccatctcaagctctgctcctaggaaacttgacctaagacattccaggcagaaatttcctcttaccccagcatttggccactctttctccagctccttctctcatctctgtttctccctactttcccaaatgtagtttaatggtatagacttccaaggcccagaccttaggaccataaaagacccaatttacttctcctgggcttgagaaagacatgcttctcttaagtagcagaagccaataataaggttgagttttcttatgctgctacattaaatccttaatataactctccctattatattaggaggtcacatgttcactagctatttttatatcttttgtaagttatcactttctgttatttaccatttgtttggtaatttatgtctctatgagtaatgctaaccttttgtctgtaacaaacatatgttgaaaatatttttccaagtttatttattggtcacacagaaggtttatgttttttttttgtttttttgttttttgtttttttgagacagagtcttgctctgtcacccaggctggagtgcaatggtacgatctcagctcactgcaacctcctccttctgggttcaagcgattctcctgccttagcctcccaagtagctgggattgcaggcacctgccaccatgcctgggtaatttttgtatttttagtacagatggggttccgccatgttggccaggctggtctcgaactcctgacctcaggtgatctgcccgccttggcctcccaaagtgctgggattacaggcatgagccactgtgcctggccctacatttttatgtagtacaatctgtcagtctttcctgtttggtttctgttattgacgtgatgatttaaaaatgccttccccatcctggagttataaaactatttacctaaatttccttatggtattcttttgcataccctttttatttttacatctttgattgatttttttttgtgtgtgtaaagagtgagataggcatccagcttaattttttctccaaaggactagtaaattgggagaggtgtaccagagtgttttcctaggtcttgattctatgatagtagccatgtgaagttaagtaagttaattcccttccccaagccctattttcttatctgtaaaatgaggataaaatggcagttatctcacagcgttgttgtgagaattacaggagaaactacatgtaaggcattgcctgcacttaagtgttagctatttttattatgtagttctagatactagctatagatattagctgtttttattatgtggctctgttctgatagctgtgtgatatctcttcttcctgcccatttctatgagagttttgttggttcaaagagttcttagaaacatttgttccctaattaaaaatggaaaattatttgtacaacctcaaatgccctcaaaacagataataataataataaaaataataatagtaatagacaacggctattttgcacacacatatgggaacagtgggagcaagagatgtgggtttatgtgttttccttgactacaagttgtaaaagccaagagagctcaagaagagatccaatcaacatcacctcttgctcaaatgtaaattgcaaaagaaactcagttgcaaagtgcccaagcatatgctcagataatttccaaagtttgtttttagtttctacattggcaagagagcaagtacttttctacttccagtgtcttcaggggctggagacttctctatttcctcttttgcatacacttggcctatcaattatttaataatcaattctccagcacacttcctattgatttcctttcattttgaagtttccttttttttttttaaattatactttaagttccaggatacatgtgcagaacatgcaggcttgttacataggtatacatgtgccatggtggtttgctgcatccatcaacccatcatctaggttttaagccccacatgcattaggtatttgtcctaatgctatccctccccttgccccccaccccctgacaggccccagtgtgtgatgcccccctccctgcgtccatgtgttcttattgttcaactcccacttatgagtgagaacatgcggcgtttggttttctgtttggtttgtgttagtttgctgagaatgatggtttctagcttcatccatgtccctgcaaaggacatgaacttatccttttttatggctgcatagtattccatggtgtatatgtgccacattttctttatccagtctattattgatgggcatttgggttggttccaagtctttgctattgtgaatagcgttgcaataaaaatggatgtgcatatgtctttacagtaaaatgatttataatcctttgggtatatacccagtaatggaattgctaggtcaaatggtatttgtggttccagatccttgaggaattgccacactgtcttccacaatggttgaactaatttaccctcccaccaacagtgtaaaagcattcctatttctccacatcctctccagcatctgttgtttcctgacgttttaatgatcgccattctaagtggtgtgagatggtatctcattgtggttttgatatgcatttctctgatgaccagtgatgatgagcctttttttttttccatatgtttgttggccacataaatgtcttctttgagaagtgtctgttcatatccttcacccactttttgatggggttgtttgtttttttcttgtaaatttgtataagttctttgtagattctggatattagacctttgttggatggatacattgcaaaaattttctcccattctgtaggttgcctattcactctgatgatagtttcttttgctgtgcagaagctctttagtttaattagatcacatttgtcaattttggcttttgttgcaattgcttttggtgttttagtcatgaagtctttgcccatgcctatgtccagaatggtatagcctaggttttcttctagggtttttatgggtttagttcttacgtttaaatctttaatccatcttgagttaatttttgtataaggtttaaggaaggggtccagtttcagttttctgcatacggctagccagttttcccaacaccacttattaaatagtgaatcctttccttattgcttatttttgtcaggtttgtcaaagatcagattattgtaggtgtgtgatgttatttctgaggcttatgttatgttccattggtctatatatctgttttgtaaccagtaccatgctatttcggttactgcagccttgtagtttgaagtcaggtagcatgatgcctccagctttgttctttttgcttaggattgtcttagctatacaggctgttttttggttccatataaaatgtaaagtagttttttctaattctgtgaagaaattcaatggtggcttgatgggaatagcattgaatctataaattactttgggcagtatggccattttcacaatattattttttcctatccatgagcatggaatgtttttccatgtctttgtgccctctcttatttccttgagcagtggtttgtagttctctttgaagaggtccttcacatcccttgtaagttggattcctaggtattttattctctttgtagcaattgtgaatgggagttcactcatgatttggctgtttgtctgttattggtgtataggaatgcttgtgatttttgcacattgattttgtatcctgagactttgctgaagttgcttatcagcttaaggagattttgggttgagacgacagggttttctaaatatacaatcatgtcatctgcaaacagagacaatttgacttgctcttcttgctatttgaataatctttatttctatctcttgcctgattggcctggccagaacttccagtagttgaataggagtggtgagagagggcatccttgtcttgtgctggttttcaaagggaatgcttccagcttttgcctattcagtatgatattggctatgggtttgtcataaatagctcttactattttgaaatatgttccatcaatacctagtttattgtttttagcatgaaggggtgttgaattttaccaaaggccttttctgcctctattgagacaatcatgtggtttctgtcattggttctgttaatttgatggattatgtttattgatttgtgtatgttgaaccagccttgcatcccagggatgaagccaacttgattgtggtggataagctttttgatgtgctgctggattttgtttgccagtattttattgaggatttttgcattgatgttcataagggatattggcctgaaattttccttttttgttgtgtctctgccaggttttggtatcaggatgatgctggcctgataaaatgaattagggaggagtctctctttttttattgtttggaatagtttcaggaggaattataccagctcctctttgtaactctggtaaaatttggctgtgaatctgtctggttctgggattttagtagactattaattactgcctcaatttcagaatttattattggtctattcagggatttgacttcttcctggtttagtcttgggagggtgtatgatgaacacatactttctaccgaaaagagctgaacctgtcagtatcttatattaacatcatgttgctgtgaagacagagtccatgcttcttatcatgatgtaaattcaactcagggagaagtgtctagtctttatagtatattacagggtaattataaggcaataactggttctctggtagttgaggcagggatggatattgtacagcagaggctgctccaccctgacactggagacacctattgtaaacagacaggggctggtgttctcttgccattgtgcactgtgattatagaaagtgtggtaggcactgtgagtttccaagtgaagatgctgtaatgggggatgatatgagttgaaggctaaaaaaaaagtggggtatgacttgtgtacaactaaagagaaaagttggcaaaaagggaaatgtgaaaagaaagactagcactaatgtgaggtaggaagccaaggctctaggagacagcctatgggggaacaagtggaggtgggcttctgcaatgctgaggctcaatactgcaatgctgaggtgggattctgcaatgcttgaggctcaaggaccctgcttgaagataactacggggcagcctgggttaacaatgctgacttagacagctctttcttccatccttctctgagaccagaggggatgggtactggcaaattcgggatcagagtaggggttcttaacttggggtccattgaaaagtctttgatagaattctgggagtctatgaactcagaagggaaaaatattacgtttctattttctctaatatctaattgaaatttaccatttctttcagttactgaatgtaggcaccaaattacagtagtattaacagtgtctgtgactttgttaccagtaaaaaaaaaatcacagatattttaatttcacattagagtcattgcagatacatcaaacatcattcatactcactactttgaaattatggatattattaggccctctgatacatctcgtttaatacattaataaagaagcccatatattcttatagcatattttaaaaacattttgatgagtgtattttaatatttttgggtttcctgtgtcacccattgttttttattttgtgcatttaaaaatagtattctgagaagtgattcataggcttcaacagattaccaatgtagtacttgaacaaaaaggtcaagaaacacaaatggataggaggaatgaatattgtgaaaatggccatactgcccaaggtaatttatagattcaatgtcatccccatcaagctaccaatgactttcttcacagaattggaaaaaactactttaaagttcatatggaaccaaaaaggagcccacattgccaagtcaatcctaagccaaaagaacaaagctggaggcatcacgctacctgacttcaaactatactacaaagctacagtaaccaaaatagcatggtactggtaccaaaacagagatacagaccaatggaacagaatagagcccttggaaataatagcacacatctacaaccatctgatctttgacaaacctgacaaagacaagaaatggggaaagattccctatttaatgatgctgggaaaactggctagccatatgtagaaagctgaaactggatctcttccttacaccttatacaaaaatcaattcaagatggattaaagacttaaatgttagacctaaaaccataaaaactctagaagaaaacctaggcaataccattcaggacataggcatgggcaaggacttcatgactaaaacactaaaagcaatggcaacaaaagccaaaattgacaaatggggtctaattaaaccaaagagcttctgcacagcagaagaaactaccatcagagtgaacaggcaacctacagaatgggagaaaatttttacaatctactcatctgacaaagggctaatatccagaatctacaaagaacttaaacaaatttacaagaaaaaatcacccccatcaacaagtgggtgaaggatatgaacagacacttatcaaaagaagacatttatgcagccaacagacacataaaaaaatgctcatcatcactggccatcagagaaatgcaaatcaaaaccacaatgagataccatctcacaccagttagaatggcgatcattaaagtcaggaaacaacaggtgctggagaggatgtggagaaataggaagacttttacactgttggtgggactgtaaactacttcaacccttgtggaagacagtgtggcagttgctcaaggatctagaactagaaataccatttgacccagccatcccattactgggcgtatacccaatggattataaattatgctgctataaagacacatgcacacgtatgtttactgcagcactattcacaatagcaaagacttggaaccaacccaaacgtccatcaatgatagactggactaagaaaatgtggcacatatacaccatggaatactatgcagccataaaaaaggatgagttcgtgtcctttatagggacatggatgaaggtggaaaccatcattctgagcaaactattgcaaggatagaaaaccaaacaccgcatgttctcactcataggcgggaattgaacaatgagaacacacggacacagggtggggaacatcacacactggggcctgtcatcaggtagggggagcagggagggatagcattaggagatatacctaatgtaaatgacaagttaacaggtacagcacaccaacatggcacatgtatacatatgtaacaaacctgcacattgtgcacatgtaccctagaacttaaagtgaaataataaaaaaaaggcctagatgaaaaaaaaaaaagatcaagaaatgctgggttagatggtgcagaaggggtagatagctagggagactcttatctttggaacctagagggaggaggttgttgtcaaagagaaaattgagagcatgctttgggaggtgtaaggacccaactgcctggacttttgaccatgcattgctgctgtagtttgttcagggtggtcctcaggtctgcgctggctccctgggcagatgatggagctgaaagaacatgagtctcagggcctgttcaaggctggtggacctaggtctggaaagataagctatggtaagaatgctgcttgcctgattagtctcagattgtctatctgataactgagttggcagttctgagattaagagctaggcttgccgcagaccgactgggtcagcgtggactagccatgtaactttttttttttttctttttgagacagagacttgctctgtcgctcaggctggagcacagtgatgcgatctcagctcactgcaacctccacctccagggttcaagtgtttctcgtgccttagcctcccaagtagctgggactacgggcacgactaatttttgtatttttgtagagatggtgtttcgccatgtcagccaagctgggtctcgccattttggccacttctccatgttggcctgatccatggatcaccccaagtgatccacccacctcggcctcccaaagtgctgagattacaggcgtgagccactgcacctggcccagccatgtaacaacttcttttttttaaagatggagtcctgctctgtcacccaggctggagtgcagtggcgcaatcatagtcctgctctgtcacccaggctggagtgcagtggcgcaatcatagtcctgctctgtcacccagggtggagtgcagtggcgcaatcatagctcactgcaaccttcgcctcacaggttcaagcaattctcttcctcagcctcctgagtagctgggattacaggtgcaccaccaggcctggctaattttttgtatttttagtagagacagggtttcatcatgttggacaggctggtctcgaactcctgacctcaggtgatcctcccggcttggcctcccaaaatgctgggattacaggcgtgagccactgtgcccagtagccatgtaacttctgacctctagttttctcatctctagattgccattcattcagttaatattgattaagctccaagcactgtgtaggaggctgaagcctctacaatcattgagtggattaaatgagatgctgcgtccgaaagcactttgaaaagagatgctcccattgaatcagttccttttaaagttacccatattttctgctctttagtcaagttgcctgttgaagagaagagacttgggtctttccaaaaagagtcagcctagggagtttgcagctccactgggtcgacccttccagtcaccctgacaatgcagggtaaagcgtcaggaccaaattccagagagttgttttttttttgccagatgagaccagactgctgaattcggttagagctttcagcctggctaacagggtgtgcatggttatttatgcactgaagtgctctgataattaagctcattcaatgtcacaatgattggttacttaagaggcctgaatcatcataagtgaagactgtcatttgaatgtatgtcacactgcttgacttagaagtacagcacagtttattgcaagaaggccaaaggaaaaaaatgttcatgtgttgaaggcaaaagaggcaggtcagggcaagtgggccagaccctgctgtgatccagaaggcactggaagccttcaaggatacccttttctcttggtagaacagaagagggcatgccagcttttaaatcaacacagttctaccttcccaggtataggccttctggaaacaagattttaggtcatcactaaaggtgacaacctttgctgatcatacctcttacattgtctatcttccaaccttggctaccagccctacttttgggagtttgacagctgaggccttgcagaacctgtgaactcactggtgcggcgatggccacggaagagctgattctaattgtaaagacagcagaaggtgaaaagcttgggctctggctctagacttctcatatcccaccattgcactgactggctgggtcactctggctagttgcttagcatctctgagcctttttctttatctcaaacataagaatggcagtagctatcatactggattttctgaagattaaagagagaatgattcttttttttttttttttgagacggagtctcgctctgtcgcccaggccggactgcggactgcagtggcgcaatcttaaaagagagaatgattctaaagcacttggctccatgcctggtctacagtaggtgctaaatcaatgttagctgttgttactactggggggttgctgtggatggaagcaaacttgtcagaccctcctgggttgtgttgctttccccaaacccccttttcttctggcattgtgtcttctgctctgattggcgccctctctctattcctaggaaaattcttgcacatttttctcttggtcctttagtttaaaaacttggcttgcgtttcccccaagagcagaataaacaaatctcttttataaggctgtaggattctgataggaaagttcttcagaatcttgaacaaggtcaggaaatgtcaccttctgacttcagtgcttggaaaattagcataagggaggcaggggaaggaaggaaaggacttggccacttcttaaactgaagggacgattacatcacttgtgagtggcatgttcttggatacatggtttaacctgtctgagcccagggctgttgtggctgagacagtgctatgtccaccacaaactctcctttctatggtatggtgttggtgttttcactgaggggtgcctgtctagccagaaattccacattccacctgcacttccatttaagtgaggccacttgaccagttctccccagtgggatgtgaatggcagcgatgcatcctttgtgagctgaggcttttaagaagctggtgaggcttcctatgctttctttctgcttctgctggctagaaacaaaggacactgaggccctcgggggatggtagagccacaggaagcaccccgggtccttaaatcaacatgcggaggaaagccaacggccagccatggatacttgcattggacttttaagtgaatgagaggtaaatttctattatgtgaagatattgcaaatactgggtttatttgttataatagctagtgttattctaactaataaagccatcgtataaaaggggtgtactagtttgaagtgcttcacaaacccaggttgcaaatgtcgtattcattgatgtattcatctgttcgctttcaaaaataaatatttattaagcacattctgtaggccctgctctaagtgctggagatacagtgaagtgcaagacagatgaaagccctgctcatataaggcatttacaaatataaggatgatgaaaataacctccttcccctcttcccacactggtgatatttcatctccatcaaatacttgcttctaaaccatgctctttcctgcctccatgctgttggagaagtgttctcttcctgtgaactccttctctttatagacccagctctcccgtgggcagcccctgaggagaggaactcctcaggccaaggcagcaactcccttctacctgtcttcctgccctgacaacagcatgagctgtgttgtagtctgtttgcttttttatgcactgatttccctctgcagtctgtgacctccttctcatccacctttgtattttagactattgcacaatgctgggcatacagcaggtgctcgctgaatatttgtagagttaatctgaatataaaaccaccagaaatgactatttggttttgtcaggaacctgcaaaatgcattgtgtgcgtgtattatttttatttttttgagacagaatctccctcttttgtccaggttggagttcagtggcttgatcttggctcactgcaacctctgcctcccgggctcaagcgattctcatgcctcaacctcccaagtagctgagattataggcatgtaccaccatgcctggctaatttttgtagttttggtagaaatggggtgtcaccatgttggccaggctggtcttggactcctgacctcacatgatccacctgcctcagcctcccaaagtgctgggattacagggatgagccactatgcccggactgcattgttttgaaagcagcttttgtttagtgtcagtgtctagaacaccagcccctttcactctgtgcatatggtgactgagctgatttcatttagtatgtgcataaatactcttatttctcagatacaaggcaagatttctttgttttcttgtttgtttctttgcttcccctggttgcaaaacatatcctctctacctcctggcaaatctgacaacacgtcctcagactgatgaaacagagtccactagatcctcttgatgggggcatgagggtttgggtaagggtgggatgaggtgagtttccatctgtgaattctcagattttgctctttattcttcaaattctcatcagactgacagccagtgatgcgtgggtgaagataagaccatagctgagaaatctcttccgtttatggcagaggtcatttcattgacattccttggagaaccttattgcaggaagatagggaggaagagaagagagcacccattctgtgagcacccttatctgtaaaaggtccctggtgtctcccctttgggctggaataaaatgagactttagttatggaagagaagaaagaaagtggtttttatgataggaggaggctgaagaaagggaagcagggtgaatggcgtatactcagggaggatcagaggtttgagtggagataaatgaacaaaaccatcttggagaccagatttttcagaggatgggggcatggaagagaccatcagttctttgggcagaagtagaggagttcctctgcaataggagagggggatgttaaggggattagcagtgttatctgttttgggatgctgaaggatgttttgccccctttaaatggtgattgatctgggaaagaccccaatatatgaagcagaccctcaggagtataggtctaaagccccaggaatgctcaccacacctgggaggctctgttactgggaacagtggtgctaatgagaaagtcaatcatgccttttggggttactgctattggtggcctgctcagagcccctttattgggaggtgtgcccatcatccctcagctactgggagtgctgtagctaatggtttctacctaagaacttacctaagaattggccctgaatgactgaaggtatatcatctggcagtacctgggaagttggtcccccatctccttggtgtgtcagtgactgatacaggtgcacagaatgtcagctccttgccttaaggcagatcaacactgtggtgtgatttatgctccagagctcccaatggatcaggccaaggctagattttaccccaaaccccattcttactggactcttccttccctcttctacttccttccctcccttacggatttcttctgacaactttaccttgatacaacacctgcatctgaatccctatcccaggttctgcttccagaggactcacctcaagactcaacctactctgtgccaggttccatggtggtcctcacaacaaccccctggggcaagactgcttccctcctgccccacactgcccccttggcccagaaggggcttccaggctcctctgcagccccctcactggtcgctaaccctactgcttagagcttaatgttcactgggccacctcttgctagtaagcaagacctctgcatgccagtgagcagtgtctctgttctgcctgcccctgggaagtggagactggctattcttgctacatgactggtagggtctgtggactcagtgtttgcttggaagacctggtcacatagatttctttccataggtgagcatgcaaagcccaagatttaggttttggggcaggagggtagggggctcactcagacctggggacttgtttgtgacctccagttgccctttgtctagagaagtttgtatttgaatactgcatgtgtgctcgaagctggggctgtttctgttctgtctgtggacccttaggtgtctgttccttggcagaaatccaggaggggatgaggagtgaacggtggggcttaagcatcagccccctacccctgaacccctgacaagccctgcaaaataaatattaagattcctgtttgactagagaggaaaccaagtcttagaaagcttagatggcccgaggatgaaatttagtattgtctgaggtggaatttgaatcctggattggctagttccaaagctcaggcttttttttttttttttttaatccataccagagattggcaaactacaggtgaaatcttgcccactgcctgtttttatgactaaagttttattagaacatagccatgctcatctgtttagattagattatggctacatttgggccaccctggcagagttgagtagttgcaacagagaccctatggcccacaaagcctaaagtatttgctgtcaggacctttgcagaaaatgtttgctgacccctgctctgcactctattctctcagggagtgttccttttagagtccagggagcccaagacactgaggggtggaaagatacctggtctttatatccaaagctctgggtacaaattttgactgtgtaacactagtcaaggcatcagtagacttgacttctcttagtcttggttaattcatctttaaaagggagagaagagcagcccccaaaaatagttttgttttgaggatgaaataaatgaacagtgataaataatgattttaaatatttgagttgaaataatctgtataccaaaccctcatgacacacagtttacctatataacaaacctggttgtgtacccctgatcctaaaataaaagttgaaaaaaaggttaccgagtgcttattatgtgccaggtccttcacgtacattatctcttttaattcctataagtgtccagtacgtggtagacattcaataagaagacattgaatgaatgaggtaggtacttattattcccatttctcagataaggaaatagaggctcagagaagtgaagcaacttccccagggcttggctgcctgtgatggctggattcagcacaggcatgagagaggaagggcactgtgttcctgctgaaggggagggtttttctcttcctgggaaaacttgtggtctttggggctggtttccactgaaggtagtgagtattgctttctctcagcttctcctccttcaatttaatcagattctattctatcctcttcaacttcccctacattatgtagcaactgggattgtcagcaaacccatcatcttgttgttgtcagtaaaacaaagattatctgcctcagaaaagtgaacacttgggagtcataattatgggaatcacttgtagtttgggtccatttgaatgtgtttgagccgcaagcgaaacagatagtgtgctcgaaaccttttctagttgtggccctggttatttttgtcctgcagaaagaagtagaactgtcactctacctgcacagggcagacaaagccacctctctcaccagctgcccctgacctttgtggacaactgcacatggaatgaatagaatcctgaaaacttctcaggagtttaatagcttcaatgaataaagaattttggttccaggaaaaggaaaataaactgaattgatttgaggaaaaatcattgtgttagtttgtgtttccctggatgcagactcagaaacagagatagcgaagaaagtttcctttttgggattggattccagaaaatgcagtgggaaacactgggaagtgagacagggaagggaagtgatatggttaggctttgtgtccccactcaaatatcatcatgaattataatccccataatcctcacatgtcaagggtgagaccaggtggaggtaattgaatcatgtggccggtttctccgatgctgttcccgtgctagtgagttcgttcttactagatctgatggttttataagtgcttggttgttccttctctgttcattgtccttcctgccgccttgtggagaagtgccttgcttcgccttcgcctttcaccaagattgtaagtgtcctgagccccccaccccggccgcccccagccatgctgaactctgagtcaattaaatctctctcctttataaattacccagtcttgggcagttctttaaagcagcgtgagaacgaactaatacaggaaggaagtctatgcaggatgtgttctcaggtagatgaccaccttgggcaaaagaagattaattccactagagaactctgagagccagaacagaactgcataattatccccctcaaggggtgagagagctggggtagttagacacccactttcatcagccatgggttgaggtatggcattttcagttggctttgctggcagaccgcagagatggaagttggttggcatgccctgaaatggtgaggctccaggagacatgggtgggaccccttcaagaactgctacaaactcctgctctgaaatcagactacctggattcaaacctccgatgttccttcctatttgttatgtgaccttgggcaagtcacttaagccctttagtcttagctgttgaatagaaaatatgatagtccagactttaccaggtggctgtgaagattaaaagagataaggcatgcaagacacttacagggtacctggcacaaggcaaacactcaacagactttagctgttatttgtaactagtctatttattgtactgaaactgactgggggaacattcagacctagacgatgttatggggaaaaatagacaagaaacaacaacccaaggttttatccaagagctatgtgatgtagagtgtgaccagtggacagcattgtatatttggacaaatatgaatatataaacttttgagttgtctttcggatattagcttgtttataggaggatcctctgcgcagttgatgaagcccatgtagctggaatcaaaagcttctgtacccatgggctgaactggtagtagcaaactgaccagggaattagagcatgacacccaagatagtgggaaccagctgagatgcaggtcataatcatgataacagcaggtaacatttactgagaattttctgtgtcaagccatgtgcaaaacacatcaccagattatgacattttctcatcacaatagtccaaggtggtgtccctgtcatgacagcctgcctactctcctttcagagtgcatgttaaaataacctctcactgcaaccagtggatttcccagtagtctctcttttttttttatttttttctggagtccggcctttcataacaagcccccaggtgcatttggagttgctacctgtaaatgtggcaggatttctcttcatcagacttttgtccctgttctcttccctgaagagcaaacatgctgcactagaaggaatcagtggctcattgtcactggcaaagccgaggcagtgggaggaccattttttctctgggttcagcaaccctcctagtggttagcagacagcagcataatggccagccagtgtgaaactgtgcaaattgcctcataaataactcgtaatgcacaggcaacagggagaggccatagctcatggataaatgactccctgccatttcggggtattaaaccagggataatccggacctcaccatggggattcattaactactatgggtttcccgcacgcaagcctgctgggactcaggcctgcttggtgcttcttgtggcatcatgatgggggcaaaacacttccaagcagggccatgagaaagagaatgtaagtacctttaacaaaccagccaggggtgaaccctgtaggagccaagtattttctctgtggaacttgctttctgaagaaatctctttgaagcgcagagaaaaacataataaccttaacaattaacatgtattgggcatttactctgtgccaggcactgtgctaagtctttttttttttttttttttttttgagatggagtctcgctctgtcgcccaggctggagtgcagtggtacgatcttggcttactgtaagctccaccagccgggtagctgggactacaggcgcctgccaccacacccggctaattattgtatttttagtagagatggggttttgccatgttggccaggctggacttgaactcctaacctcaggtgatctgcccaccttggcctcccaaagtgctgggattacaggcgtgagccaccgcacccctgtgctaaatcttgtgtaactcccacaaacattccattgagtggatactattattattagtcctattttcatagaggatgaagtgatagctcacagaggtttagttatttattttaggcaatatagccaatatgtggtgaatgcattagtcagcttttgttaggttgtggtaacaaatagtccaccagtctcagtggtttaaaatcacaagagtgttttgctcctattttatgccactcatggatcagctgctctcctttacctgactttattacaggatccaggctgaaatagtagcctctatctgggacatactattctcatggcagaagaagacaagagcaagaaaactggtggaactggccatggctgtgaaagcttctgctcagaatgggcatatatcacctctgctcacatttcattgatcaaaggtggtcatatggccaagccttctttcaatggggtgaggaagtttactcctcacactgggaggtactgcaatgaatgacaattggggagagatatctaagtctcttagaggaaaggcagagatcagagaatagtaatataatctatgcagctgagtgagatcagatctttgtggttttacattttgtgctcttaatttctgccctttgctgaatttggagttgggatacttgggcttgagcaccactctgcagtgagaaactctgtgactaagggcaatttatttccctctctgggtcccagtttccctgccttagttagatcccccagaagcagacgcagagacaaggaatgaaatgcaagtagtttatttgggaggtaataagaggaagccccagtaagaaaggaaaagtaagatagaaaaaagaaggaaggtaataaagtatgttaccaagcaggttaccctcagagcaaccagggcagaattctgctaaagaactgtggggatacacacctcagaattatcctacccgaggggtgaggaacctggaaatttacttaccaactcccaggccatcattggttgagggctatttctgagaccattgactcttctgcaaccagataaaagcctttggagcagagttataagtttttgtaataagcatcttttggcatacagaggtgagccaaagtccctatctatgcaatgggtggtgttggctagaaacacttcaatggctcttctactttttgtcccctgtgcctacagccctgcctggcatggggttagcatgtgggcagtctggttgagtgtgaggatcatgggcagttgcattttccctccatcttcctatgaaacctcatgccccaccactggctcttcctcttgcttttccactgcatgcaaaccttggctctgcaggatgttccatccaactcctgctcttcacaaatgtgtctcttacccaacgtgctgcagttcttactgcctgctcgcattgggcacactctttattcccggtactatgctttccatggtcacagggaggcagcatcaatgatgtcctcatttccctggcatctctcactctatgcaaaatatccttttgctttgcactctgccaccccctttgctgtcatctttgttccagtactaaccatcctcccctgaccctatcaagctccattcacctaaggctggctcccagcctccctccctctctgagctaccaaccaccttggcttctcccttgtctatggggttgatgcattccatacctacagttcttgtccctgcttagttcagaccacctacatctccctccacaactcaaaacaacctcttcaaccagtctcctactgcattcctacatacacttccaaacccctaaatttctgacttctagttcatcaatactttggccaagcattctctctaaaatatgattgggtagggaagtagccaaatgtagtagttaagaatgggaactcagagatagactgtcagggtttaaatcctagctctgccacttctttcttatgggaacttgggcaagccactcacactctctgtgcctcagtttcctcatctgccagatctacctcatagggttgttgccacagaccacctggcacataatgattagatcaccacctggcacacagtagttacggaatcactgtttgttaaatacattgaatttgcaggtgatgtctgttacctgcttcaaagcctccaaattcccagtcacccagagggtagagtctgagctgtccagtctggcacttgaggccctgggtagttggcctctacctccctttccaaaatcaacccctcagttcctttttaccccacattttatgactcagctgtttcatatctctgagtctttgcacgtgctgttccctttgcctggtatgctgagccctgtcttgttctgttcatttcctactgacttctcaggagtgccctcaggctttgcttcccctggagagcttccgggtctactcggatagagataattgccttcctccttgtagaaactgggcactgcccctgtttcagggctgagaccagagtgggatgagtgagtttgcttcaaaagtgaaatttaagggggcattcaaaaactcagtaatcaagagagaatatttgaatattaaaataaatcctgtgttagtttgctgaggatgattgtttccagctttattcatgtccctgcaaaggacatatattcattcttttttatggctgcatagtgttccatggtatatatgtgccacattgcatgttgtcactcataagtgggagttgaacaatgggaacacatggacacagggaggggaatatcacatactggggcctgtcggggggtggggagcaaggagatgtggagcattaggacaaatacctaatgcatgtggggcttaaaacctagttgatgggttgataggtgcagcagagcaccatgacacatgtatacctatgtaacaaacctgcatgttcagcacatgtatcccagaacttaaagtaaaattgaaataaacaataataaaatcagtgcaataagtctaggttgaaaagagcatcaacattttaaacaaagatgagatctaacctgttctcatgagactcatgccgcttgcctggcctgttggatcctgggctagcctgctggagattgaaagatcatgaggaggtgagcccagttgtgccagctgaggttattcaggttattctagactagtttacagccagctgacctcatacctgtcagagggcccagccaaggtcaacagagccacctacatgacccacagctgaagaagacacccgagcaagccccactgagctgtagacctgtagacctgtgtgcaataccaatacttatgattttcaactactacgtttggggatgatttgttacacagtggtagccaacaaatacacttcttctggccacagagcctttgagcatacttaacctctgcctggaaagatctctcttccctaggccccttcattccttaggccttcagctagtgctgctgctttagagaggcctttcctgacttcactatgtcaaagctccctcctccaggctctccttttactctgtaactctccatctttgcccttcactgcagttctactgcatttattcatgtgattgtctgatgtcagtctcacctgatagatggcaagctgcatcagggcaagaattatgctttttaggtctccattgcattttggcccatagttggtgtttgataaatgtgctgaatgaatacatgaatgaatgggtttattttgagacaaaatttgagagtgtggatcaagccccatgatttctctgccttttacccagtgacataatatgtaaaatggattctgatgcaaaggtcatgggcctctcctgggggcgcccctccacccctgtgcatcatagctcttctctcatcttctgagcagggtttgccagcagaacataaacaataatgtgaatggcactcttggagttgagcagccctgcactgagtgtagtggaagcacgtctggctaagccagggctagagtagtgcagatgggaggatgtggacatgacttgatgagggcagcagccagggatgggctaaaagggagggttggggggcctccctgaggccctctctctgattacctggtatcactcccttcacactgtaggcctccttctggcaatttaagattctgccccaggctctggtggccccgtggagcagaggatctgatgcctggtttcttgacctccatgtatcatgattcctaattcatccttgcttctcagtctgggaaggcaatataggctaagactgtggaccttcaagccacacccgcctgggttcaaatcccagcacagctttctactagctgtatagctttgggcaagtaatgtaactccttgcctgtaaaatgggctcatacctacattataggctgttatgagaatcaaactgagctggagtgggttaaagcacaatagtgcttgctacatggtacgtaggatatcagtgtttttgttttcctttgatttggctggcctgaggccctgatgtgaggctaatggtcccagcacatctaaccaggctgagcatcctgtttcttattggggagtgccatgtggctccaggttatgtcttaggtgagctctggtctctgttctttgaaaggcttgctttgcaggagaaatgtccttgggcaagaagccgctctggtggggctgtctcccagatacacacatgtgcatgtacacacacacacacacacacacacacacactcctgcgtagcccactccaaggcactctatgagcctttcactccttgttcagcctcatcaacaccttattataaaatccttttccagcactctgtccaaaggtcatcacaattataatcactgctgtaattatgtccaaactcgtagccccccactggggagtgtgggagcactgtcaccagcctaagaggcccagttctgtgaggcctgcttgtcccaccctgccacactgggaacagctatgctgtccccatagggatggcaatggtagtgaggcttgccctgtaccctcagagatgcttcctttattcaagccacctgtgccccacctatgccacccccctggagtgccctctattcccagggagggccctgcacagaggcaggtgggcgggtgtcacatgggtaggggaatgacagttttcctcacatcctccctgatgctcttcaggtgtctctcctgctgttcctgacgggagtgcaagctaagtgagagatgagacaggggttttgacaggaagggcctcactgggtggcaggatggaggtgagatccctgtgctgatgaacaggttatgttgtgtgttcatgcgacagaatcagacacatgctcattttgcaggttgtgcagagaggcctgtaatctccagagactcctcacctcaaagtgctttgcctattgttatggctgaaccgtgtcttcttaaaactcatgtgttaaagtcctaacccccaggacctcagaatgtgattacatactctgatgtagaatcttcaaagaggtaataactaaggttaaatgaggtcattaaagttcttctaggcaccttctagttttgagcaaccttaacatgagagtggcctgtgatgctcccggggcctcctctgcccaactcaccaagattggctagaaataggggttggagggaacctgggaagtgagccaacatttcttcttgtgctgtgatccgtgctattcctggtctcaaattctctttcccctccacattctgcagtgcctcactttgcctgtctgtgtgctgcttacatggatacccatatttttaggggataagcacattgacagggaatcagcagaatgcagtagaggcagggatggaggagaaaacagagcatgagcaggctgtgctgaaggggaaggttcacctgaaccccaggagatgctgggagccagtggtgggtctcacaggtgcctcaactttggcctgtggcccagtggggaagggtatgggggtctcccccatgtatggaaagtgccatgctggtggcttacccctgaggggcaccttccataccccatggctctgacacaatgtggcttctaagccaaacacctaaaaggtgtttagaagaaaagaagtctgtgttacgggcaatattgcacccctctgtaaggctttgccagccttagaagtctctgtagcagacctcatctgcagctagagacagaactgaaataggacgtagctgagatacctgggtgtaattccgggggacaccacccggtacaggggaaactttgaagacctaaatcttcttcagtagtttatatagtagttcatatggtctctatatagtcactgtcgtgtatatagtcaaagtgagaaactgagtggtgagactgtgactcacttttactcccagacaggtatggcctgaaattttggcaaatattaacaatggttataaaaacagctcattaggcatttgtgatgtacttagcaaatgcatgccccaggtaatgtgttaatgttttccatgcactaagacatttattaaccttcataacaactgtatgcaggagggttattagccgctttttaatagaggcttagagaggtttcagtcacttgtacaaggacagtgacccaggaagtgaagaaacttgtgccagtaagctcaatgtctagcttgaaagtccatgtgtgcaagctctttgcaatctctgttactgcaaagcctgcaaactgagctacagcatgtgggaggactcatagtccctaatgacactaatgtgcctaccatgtgccagcattacgcagtccacatagtttatttactcactgtgtaacaggcctcggaggcaggtaatcatagcctcattctggagatgcagaaactaagattcaaagagaataagtcacctgcttgtgaatagtacagttgggattcaagctcaggctgacacaaaagccccctctttttaggcttattttagttcgaataataagaagtgtgtgtgtgttgggtagtttgccctgagctcctgacagcctgtttgatttcagcgatttccagaaacacctgggagtacatgacggtaaggcaggatctgggcatcctgctggtgctgtggacagaggcttcctatagcagccctgagagtgcacacccagcccatgtgtgggagggcagagctggttctctctctgctttattgatgtggagtgagttgaaggttattgcaatgaataataaatgagctatcatagaggagccgattattccgaagtgttactgatgtttgtgttgataaaaatgaataaatggctaagtgtttgcagggaatggaagagaaaaggcataaagaggaaattcatatgtgcctctgatagttagaaacaatgagtcttgaagcagaggcaatcatggaatgggataaaacagctttgtgatttgttatgtagggaaaataatgacagaatctttcatctctggccatgttggctgcaaagtggcaatagacattggctttgaacagaggagataagagaccaagagaaaaaaaaagttcagaacagtgaataaaagagccaagttgtggcttggcttttctcccagagacagagacatatgaggaaggacagggctgcaaccatttcagcctctctgtagatagaagaagagggcctgactggccccaaatgggggtggaggggcttctcccaggattgaaagccaagatcacatgtaaaaagatcatgagaagtcaaattcaatggatgggggtcagccaggtgtggagtagctctttggtacagatgaccctactcccgggtacaattcctgtcaagctggccacaaattctcctctttctttactgctcagaaaaagcatatcagaatgcaacagagtgagaatgatgctatgtccatgattcccaaactctgtgctgagagcacctcagtaaacttagagggtgcaatgggatatttttttttcttttttttttattatactttaagttttagggtacatgtgcacattgtgcaggttagttacatatgtatacatgtgccatgctggtgcactgcacccactaactcgtcatctagcattaggtatatctcccaatgctatccctccccctccccccaccccacaacagtccccagagtgtgatattccccttcctgtgtccatgtgatctcattgttcaattcctacctatgagtgagaatatgcggtgtttggttttttgttcttgcgatagtttactgagaatgatgttttccaatttcatccatgtccctacaaaggacatgaactcatcattttttacggctgcatagaattccatggtgtatatgtgccacattttcttaatccagtctatcattgttggacatttgggttggttccaagtctttgctattgtgaataatgccgcagtaaatatacctgtgcatgtgtctttatagcagcatgatttatagtcctttgggtatatacccagtaatgggatggctgggtcaaatggtatttccagttctagatccctgaggaattgccacactgacttccacaacggttgaactagtttacagtcccaccaacagtgtaaaagtgttcctatttctccacatcctctccagcacctgttgtttcctgactttttaatgattgccattctaactggtgtgagatagtatctcattgtggttttgatttgcatttctctgatgggcagtgatgatgagcattttttcatgtgttttttggctgcataaatgtcttcttttgagaagtgtctgttcatgttctttgcccactttttgatggggttgtttgtttttttcttgtaaatttgtttgagttcattgtagattctggatattagcactttgtcagatgagtaggttgcaaaaattttctcccattttgtaggttgcctcttcactgtgatggtagtttcttttgctgtgcagaagctctttagtttaattagatcccatttgtcaattgcaatgggatatttttaacgtttggagggaaacttgatatcctccggacatcacggtaataccagctctgctaatacagtttcaactttaggttaagctacgttccttttgatgacatcatgtctttgcaaacagaggcttttagtcattgctgtggttaaaataaagtatggtatgtaaaccactgtagagcaggcaatgaagatcatggtgtctaatctgattccaaggtttaagaagttgtgtagtgcccaacaaatatacagatcccattattaagtaattatagttatttcagaatgaaataaaaatattttttaaatcaatttatgtgattgttttttgacacataattatacatatttatggagtacagtgagattttcaatacatgtatacattgcataatgatgaaatcagggtatctagcatttccatcatctcaaacattcatcatttctttgtggtgagaagattcaaaaatcctcttttctagctactttgaaatacagcatatgacattgttaaccataaccaccctctgggaaatagcacaccagaacttatttctcctatctgtgactctctactcattaacctatctctcccttcttctcttccttctaccttccccaatttctggtaaccactattctgcttcctgcttctatgagatcagcttttttagatgctgcatatgagtgatatcatgcagtatttatctttctgtttctggctcacatcacttaacacaatattctccaggttcatccacgttgccacaagtggcaggattttattcttttttttatggctgaaatgtattccattgagtatatataccacattacaaaaaatccatctgtctattgatggacacttgggttgattccatatcttgactattgtgaatagtgctgcagtaaacacgggagtgcagctatctcttcgatactctgatttcctttcttttaggtatatacccagtaatgggatttctggatcacatggtagttctattttaattttttgaggaacggcccactgttttccatggttgctgtactaacttgctgtttcatcagcagtgtataagttctttcttgagatccttgccagcatttgttatcttttgtctttttgatgatagccattctaactggggtaaagtgatatctcattgtgattttaatttcatctccctaatgattagtagtgttgaacattttttcatatacctgttggtcatttgtacgtcttcttttgagagatgcctgttcagattttttgaccggtttttttttttttttttttttttttttaagatggagtcttgctctgtcacctagactggagtgcagcggcaccatcttggctcactgcaacctccacctcctgggttcaagcaattctcctgcctcagcctcccgagtagctgggattacagacacacgccaccatgcccgggtaatttttgtatttttagtagagactaggtttcaccatattggccaggctggtctcaaactcctgacctcatatgatccacccacctcgacctcccaaagtgctgggattacaggcgtgagccaccacacccagccctttttgcccatttttaaattggatgttgttttttggcttttgaggtttttgcattacttatatatacttgatattaacccttatcagatgtgtagtttgcaaatatttctatagttttcctcttcactgtgtcgattgttttctttgctgtgcagaagctttgtattttgatgaaatctcatttgtctatttttgcttttgttgcctgtgcttttgtgttcttgacaaaaaaatctttgcccagactaatgtcatggaggatttattctaatagcttatagttttaggatctacatttaagtctttaatccattttgagttgatttttgtatatggtgagaaatagggtctagtctcattcttctgcatgtgaatatccagctttcccagcaccatttgttgagtggttctttctccaatgtgtgttcttggcacttttatcaatcagttgctgtaagtacgtaggtttatttctgggttctccattctgttccattagtctgtgcatctatttttgtgccagtaccatgctatttggttactatagctttgttgtatattttgaagacaggaagtgtaatgactccagctttgttctttttgctccagattgctttggctatttaggatcttttgtggttccatatacattttaggattgttcaatatacgttttaggacttttatatttcagtgaagtacatcattggtattttgatagggattacactggatgtgtagattgctttgggtagtatgaacattttaaacaatattctatcaatccatgaacatggatgtctttatatatgttttcttcaggttttcatcaatgttttatagttttcattgtaaagctttttcacctccttggttaaactcattcctaggtgggaggctgaggtgggatgatcacttcagcccaggagtttgagactagcctgggcaacatagtgagacttccacttctacaatttttttttaaattacctgggcacggtggagtgtgcctgtaatgttagctacttaggaggctgagatgggagggtcacttgagtctgtgatgttgagactgcaatgagccgtgatggtgccattgcactccagcctgggtggcagagcaagaccctgactaaaaaaaaattcctaggtgttatttttgtggtgattataaatgggattgatttcttgatttttttctggatagttcactattggtgtatagaaacactatatgtgcattgtttaaaaaatcagctactgttaggacatacttattaaattgtttagctctaactaaagatgaggtatttctgttaatcatgaacatgaaaaaaattgtggagacactaaggatcctgtcaacagggaaagtgggggggaacttctgttaggtcctagcaggaaaccaatggcacactcaaactggataatttaaagagagtttgagaaaggaatttttttcaaagatgtgggaaaggtatagagaaatcacaaggaataggcagtatcctgaggttagtactggggagagggaattggaaaagttgggaggaaaaaagagggtgggagggaagaagtggttattacaacctgtagatcatgctgtggagagaggcctgtctcacagtagtaaagagcttcagctcagcaacatggtcagcttcagttcttggcatagagatctgggaaaagaggtgccctgacctcactcttatccttccctctctcccagtttctgcaggtgttccccactggccaagcccaggagagggcaagggagcctcttgacataaccacaggacttagcttccctggtacaaaagaaggtggaagactagtcctggaagggcaaccaggagcaatccaatatattatgatacagctaaatttgaatctgctgttgcttatacaaagaatagtgaatccttctcaagcttcagaatcaataagaacacgcatttatcaagcactttactgtgtgctctgctgagttaagcactttacaggcattatctcatttaatccataaacaaccttaccaagtagattctattgttcactccaaaatggaagatagaacaaatacatggcagcattgctgtgaagaggagagaaaatgaggaggagagaaaatgcatcaaggtaacttccttcatgtacatagtgggctcagtcaatggaaaaaaaaaattttgtttgcttttttgagacagaatctcactctgttgcccaagcttgagtgcagtggtgcaatttcggctcactgcaacctccacctcctgggttctggcgattcttgtgcctcagcctaccagtagctgggaccacagacatgtgctgccatgcccagctaatttttttttttttttttttttttttttttttttttttttttagtagatacagggttttaccatgttggccagactagtctcaaactcctggcctcaagtgatctgaccaccttggcctcccaaagtgctgtgattccaggtgtgagctaccatgcctggccatcaatggaaatattttttgctataatttttttttttattaaaaaatctttccaatagggaagaaaaagtgttggccaactaacataaaggtatttctttccttggcacttccatttcccagtcaaaattcacaaaatggcctctggctcttgcgagttagatgagtggtcattaacattctggattcctccagaatccagttacttttgtgtttcccattctgcagtgtggtggatgaaaccaatgccatggtggcctcaccaaggtgccacatcccacagagaccaggctgcaacactggcttgtcatagttatgccatggtggctctcaaaggatccccacggggaacaccaaaatcacatcatggtggccttttccctactcatcaataacatcaaggtcttgggatagaactttctcaattctaactttttcttccataaattttctttaaactgagccaaaaatgaatgaacaataaacattaatgggaaattttaaaatgtgatttttaaaggagtgttttatgtattgttacttttttgagatgcagaaacctgcatgcatataatatagccatattttctggtagtaaagttgttgctgactcgtgtgacagaattaagtgcatcaattttttcttgtggttatgcagaaagcatcccatcttcccaatgtctgaaagaatttgaaactactttgatagaaaaacttgcatatggtataaaatttaggctctaggaacattgtgagcattaccactatcatcatcatcactgtcatcatcacctctgtcatcattatgaagatcatttctttccaagggaatcaaaatgtgtcctctgtgtgtcttcgctacattatattaagcagtggttctcaaagtgaggcttctggaccaagcagtgtcagcaaatgcaaattcctaggccttaccttagaaaaactgaatcagaatctctgggcatggagcccagcaatctgtgttttgataaagcctccaggttgagaaccattgttttttagtaattcttacacaagccagtgagataggagccactgtttccatttcagtgctatgaaaacaaagggtgagagaatattgcagttattaaatggtgagactagagcatggattgaattcttccacctctaggatgagtccttatcccaacatcactcttatatacataactaatgaatcaggaaactgtgcgtccactcttttgtggaagatatattaataggtaaggcacagttgccagaacttactctcttaagaagataaggcaggaaacgcttagcaattaaatgctaagtggcatcatttccaatgtcataggtttttggtgatgaaagaggtcactgtgggctggactgagtggtgtcccctggaattgttcaaagtactccaagttgctaagatcttgatcaaatatctctagaaataagtggtcttcagttaggtctggaaggacaaagtggatctggctggctggtggaggaggaggaggtcaatagttgattagcaaatggacaagaagggtgtgactttctattgttaaaacaggttaaagctgagaagcagcagccagcaaaagccttgactgaaagatgagcaccttgagacctcttactgcaaaataaattctgtagattgcatctccacctgttggttgggatactgattctattccactatgaggaggtagccatttccttcctagcccctctccaatttactgctagaccaggggtggcaaaccttttctataaagggccaggcagtaaacattttggtctttgcgatccatatggtctgtgttgcaacctgtcaactctgctactgtatgaaagcagccatgggcaatatgtaaattgatgggcatggccgtgttctaataaaactatatttgtggacactgaaatttgaattttacatacttttcacgtgtcacaaaatattcttttgattttttttcaacaatttcagtgtaaaacccattcttagcttgtgggtcatataaaaactggtggcaggccagatttggcctataggctatagtcagctgatccttgtactagaccataaaccttacaaggatagaatcttttctgctcactatcatatacccaggacctgtcgcagtgcctcatacacagtggccactcaaaaaaaatctgttgaatgaatgaatgaatgaatgaatacagtctgtctattctcctttgtttcctcttctctgaatttgtccaaagaaaatatgaggtaaggaagctgagaaagagtaatcagaaggtatccaatgccttctcttgtctacatcttaggtaggaattcacaaagcttctgattttagtgaaaagaaagattaaataaaagtctctgtaagggctttagttgtcaatctgccctgaagttcagaaatactaaactcagagctcaaatatgccaagaatgtttttttttttaagcctaagaataaatctagaattataaagttgtttcctacttaaccccagagggtacactgagattaagtataattgtttatagttgtgagttagtaaggatgtgttcataatgcaaagaactgcgtggttttaaatgttctaagttgtgcattactttaaaaatatatggtaacgagatatgaataattggtgtttggtgaggttgaagtttctgtaaaatgtatttcaggctgtgcattggagctgtaaaagtgcaacactgacaccttccatgaaaaaccaggcgggtgctggaggccataactgagacagtgttgagcatggaggaacaggtcatgtcaatgagctttaaccaataaagcatcttggaaacatctgagaaatcaaaaatatgacttgcaaagggtgattatatacatggggaggataactaggaaagagcctcaaaggctagaccttccttctgggataggggaggaggatatatgccctttgggaagagaacagagctagctaggcacttcagatcagagctgtgggtgctaacaactaatttgtgctggttgaaacttaccattgtccaagaccttccctttctgggtcattcttaacaattactattatactttaataattcaatatagagtatttatatatatgtgtgtatatatatatatatatatatatatatatatatatatataactttttaaatagagcttaactggatggagacattcactgtgttgctgaaatcccttttattcagaccatgattccgttattgtttattttttctgcttttccagcactcattacctccttcattgtaatgggggcgggcctcatccctctgcctctttccatttaactgaggcggctctcaccctctggaccaggcaagggcacatgatcttgggctagccaatcaaaacatttcattcttctagccatagtgattggttcaggaatgagcatatgacctaagctagaccaatgagaaccattcccaggtctttcctgagcccactgattaagtagttaagcttctaggctgctaactggaagcttctgttggtgacttccttgagggaggattttttttttttttttttttttttgagacagagtcttgcactgtcacccaggctagagtgcagtggcatgatcttggctcactgcaacctccgcctcctgggttcaagtgattctcctgcctcagcctcccgagtagctgggattatagacatgtaccaccatgccccgctaatttttgtatttttagtagagacggggtttcaccatgttggccaggctggtcttgaactcctgacctcgtgatccacctgccttggcctcccaaagtgctgggattacaggcctgagccaccgcgcctggcctgagggaaggacctcttgagaagggaggtatcacaaagatggccactgccaatttaccttcccttgtggatcttttgctttctaatcttcgctgtggtggggaataatctctactcaaagtgtttggtggattacatgaaaaatacacagcaggtatttggaagcatttccatcttcctttcttccttctttcctctttttctcctatctctcttttcttccctccctccttccttctccccaaccttaccttcctttcaaggaactttccccaaagggagattatttaggtacaggcttggcaactttttcccagtgacttctcttccatgggactggggcagccacggggcagtttcttgaaggcttcagtgaaggtgagatttgtagggcttttgtgatcacctggaggatgcagggctgagattggtagagggtggaggttaaaggagcagatcctttttggccatgaaaaagaactttctaaccaaagcatttttcaataaaggcaagagcatcttaggtggtgtttccaacctggggcatccagccaaggattaatggccatctctcagtgtattaggattctccagagaaacagaatcaatataatatgtttgtgtggatgtattttaaaaactaatttattttaaggaattgactcacatgattgtggaagctggcaagcccaaaacctatagagtaggctggcaggttccaggctaccctggcacccagggaatagttgatatggcagcttgagtttgaagacagtctggaggcagaatttcttcttccccagggtaccacaatctgttttttcttaaggccttcaactgattggatgaggcccacttacattacagaaggtaacctgctttactcaaggtctactgatttaaatgtaaatctcatctgaaaaataccttcacagtaacatccagactgatgtttgaccaaacgtctgcgtactgtggactaaccaggttaacatataaaattaaccatcatgagtctacccttgtcaacttcgtgcccattcacatttctgtaagtcattttaatctccaaatagagacaataacaagattatgcttctgcctaacatgatacaaccgtcctgtgtgcaactgaaaacatgctaaccctttctccggaaaatacaaagtctttgagtgatacttttcttcatgatatcccgtagcttaagtactatgatgtaaagttaacaatacgtaaataccgtgatataaagtcaacacgttacatgacaaggggagaaaaaagggaagaaaacaaagatatttgcttcttacatacatgcaaactttccataaaaaataaggaataaaaactcatgataattatgtttcccatttctatagctggtcacagctggtgtttataactaccttcttctgtccgttctgtatttcctttgcccttgacaagcacctcagctagttgtggcttttgacttgctggggtgactctaaccttcatttctgaagggtccaggtcattagtcctaggatggggttgttacagttttgcactgactttaatcacaaggcatgataatactaagtgatgctctcaggaatctcttatattccaaacacactcttccttacctacattgtggaatagcagtccgatttccccttggtagtcaggattaatcagcccagccagcatagtaactttcttacttgctgttgcttcagaggcaggagaatcccagagtagcggttttaacttctagttcaacaggattgttgggtctcctgatgaaagtgttcctccccttagaaccaggacctctaggccagcatagcataaggttgcagaaacaagcaaaaattttgatagtgggtcactaggggaaatcgtgagtggcgtcactctcattcccactcctggattcctgaacccatgaattctggctatgggagaaacagcaccatatattggacactgattcagagcttctacagcctcctggggaaccctgccctagccttgcaaggtattgtcacctagctggggctgtaactaaaccttcaaaagttcattctactattctgtcaagccaactgcattagaatggtgggaaacatggttaaaccagtgaatttcatgagtgtgggaagtgagttccctgatcagaagcagtgctgcgtggaacaccatgatggtggatgatacatcctgtaaacccatggatggtagttttggcagaagcactgcatgtagggaaggcaaatttgtatcaaaaataagtttctattccaataagaaacaattctgcctcttctgtggtggaaggggttcagtgtaatcagcctgtcaccaggtagctggctgatctccctgggaaatgatgccatctggggagtcagtgttggtctctgttgctggcagactgggtatgcagtgatagccatagccaggttagtcttaccgagtggaagtccatgttgctaggtctgtgcgtgacctccatctctgctaccatgaccacttagttcatgagcctgttgggcaatatcaggggtgtcttgggaaagaggctgactagtagccacaaaatgggttatccaatccacttgactattacaatcttcgtctgctgaggccactgtttgatgagtattcaaatgggacataattcctttaacattttttgccaatccagagaggtctatccacatacctcttctccagaccttgtcctattttccaatcatggtcaagtcccttaccttatagcgaaaccattggtcacagcccatgaatcagtacccagccacacatctgactatttctttttccaagtgaaatgaacaaccacgtgtgctgcttgaagttctgcccactgagagaatttctcttcaccactgtgcttcagggatgtcccagagtggggctgtagcactgctgctgtccatttccaagtgatgcctgcatatcgtgcagaaccatctgtaaatcaggattattttctttttctctgtgaagggatcctatggaactccccatgagacacactcacattatggagggtaatctgctttactcacagtctgatttaaatgttaatctcatctaaaatacctattcacaacaacatccagacttatatttgcccaaatatctgggtaccatggcccagccaaggtgacaaataaaattaaccatcacgatcagggatgcaatagagggggcttctgttcagggaggcagtctggactaagcttccaagaggacttctggcttgcaaattgcaatctctgatttgttcagctaatgctaccgccaggtgctcctcccttcagtgtggacctagaaaaggtattctttctctatggcagtggttcttaagctcttcagtgcatgagaatcacctgaaggacttgttgaaacaccaattgtggggctgcatcatgaatttctgatttagcagtttggggatgagcctccaaatctgcatttgtaacacattcccaggggttgctgatgccgctggcccagggaccactctttgagaacccctctcctatgggttcactaatttcatgaatgataactggtgtattgttgaaaaagcaccaggctaggagataggagacctgagttcttgccacttgctacttcatctagctgtgagtatgtgggcaagtcacttgccctctctgggctttcctcatccctaaaaagagacaagtcactggtgtctatctttttaggacagtgggcctccttcaatcagctttccttttggtgggcaccatgattttgagggattattttttccccagaaatacaatgtgtatttaaatagtagcctgggtagactgatttatggcaaatacctaattttctttggtcttttttgaaataaaaacagtagctcagggatctctgcatccataaccactaaattaaatgatatttacaatttcctctcatagctcaaagaatgtgacgttcgagaacaatcaggacacaatgccaagccttaacttttgggatgattatgagctttggtgcctgctgaggttgccaatagcttgttgaggatgctgtctggggcatttcaggttattagctgggaatttgactacgtggctttcgaggtttcttagctctaagaccatggttttcggcccccacagactcttccaggtcatcccttggggcccacagttgagagtttagagttggtgctaattcaaaggttttagggttcatcttccaggcatgttcttcaggaggagcattagcgtctcaaagagattaacgagttaaatgagtgtaggtgcttcctgttagacttttgttaagcagaatgagctcagatgtgtcctatgttgataaatatatcacctgagcctcacacacccagaagggatgactgctgaacatctgggcctctgctagctgctggaatccctgcctatgctggttggcaacacctctgtactcacatcttttccagctaagtgaacggttagcttatgctaaaaacacgtgtgagtgtgatcatttgtgtgcaacgcatggagtcgaaccgctaccatttggtagggtgggggaggggaaggttgctgttttgaatatgcttttctttgaaagcatgaaaaaccaaatgtgtctgtgaattggagtacattttagagactttccctatacattcaagttcataagatccttttttatacaagtgttttctaagcactaactgcctcccaggttcaatgtgaactcctgagaaaatgtcattttggccccagttcctcacagttgagcaaggcagccagtctaaacagacattaacggaaatgcagaaagctaaagtggggactgatgaggaagaaaattacctccctgggggctgtcaggaaaagctgctcttcagaccagctaaatagctaactttgggactgatacaagcaaggtaagcctttcaaatgggaaaatcaatggatgttttaatgctggctctttgaaggatgtggtactcaccaagccaaggaggggagcatttccagcagagggagcagcatgtacaaaccgccagttgttttggatgggtcaagaagccgtgtagctgagtatggagggaagctggggtaggtgagagtgagcacaggaaatcaggaaaatcaagaccacactgcagcatttcttttgtgtcatgctacagatgtgtcatactagagagcagtgattctcaaacttgagcatgcatcagaatcactgagagggctgtggacacccagattgctgggtcccatctcgagagcttctgattcagtaggttagaaaacatgcacttctggctgggcatggtggctcacgcctgtaatcccagcactttgggaggccgaggcaggcagatcacttgaggccaggagtttgagacaagctttgccaacatggtaaaaccccgtctctactaaaaatacaaaatagcagctgggcatggtggttcatgcctgtggtcccggctacttgggaggctgagacatgagaattacttgaacctggcaggcagaggttgcagtgtgcccagattgcaccactgcactccagcctgggcgacagagtgaggctctgcctcaaaaagcaaaaacaaaaaaaagcaaaaaccatgcatttctaactgcccagatgatgatgatgctagtttagggaccatacttagagaatcactgtttatagagtttggatctctgagcaatagagtattcctgagaattttctaagaaggagtattacaaagtcagacatgcattttggaagaagcattatgaagaaattgtggcaaccatgctggagtgggtagtcaggggacgggcaggtcagttacacagtggttgaaatggttgaagcaactgagaatgggtgaggcctgaactaggtggtttaaaagtgtgagaggtgctgggttttcagcctggagtgtgggctccatcttatcagcctattctggcattgagtttcgccctcctggcctagtgagtcattctgcaggtgggatcactgaggctttgagtcacgtgccaggtcattcaaaaggcaaagcactgtctctcaatgagaggcaaaagatagtatttttacccaaattctgcaggatgatctattgtggttttcattttctcagcacattttattcaattttactaggtcatttagcaaataattttaattttctgcttagatcagaatttcagaaagtaatgtactgttgtactattaatgggtcctctaataagctccactagaatgcaatttgcaaatcattcacaaacataactgtcactctgcctggttgtcaattaacacactcctctgtcattctccttgagagggcccagagatttctgggagactcctgtacctggctgggcctcccgtgagcctctgtgaaaggggaaagcagataagggagtcagaactcatttcaatgttgagctgtggcacctgctgcattcttgtttcccactgcggggcagctggttcctaatctcaaaactgaatcgcaccttgggttgcatggatcaagtaattgtaacaacttagcaggttaaacatccaggcatgtggggatttcagctgcaggatggtggtggatgaagagtaggagaaggagcaaaatttactaaacacagctttatgccaaaactgcattaggacattctttttattgatattatttttaatacaaataatacattaatacaagtttttttggcaatttattttagcaataaataatttgcctcttactctgctaacaagttaaaacaggggttggcaaactatgtccataggacaaatctatcccacagagtgtttctgtaagtaaagtttcattggaacacagccacatcctttcagttacacattatctatggctgctttcctcctgcaattgcaaagttgaatagttgtgacaaagcctcacgaagctgaaaatatttgctgtgtggttcatatatatatatatatatatatatatatatatatatttttttttttttttttatattatacttcaagttctagggtacatgtgcacaacgtgcaggtttgttacatatgtatacgtgtgccatgttggtgtgctgcacccattaacttgtcatttatattaggtatatctcctaatactatccctccccgctccccccaccccacaacaggccccggtgtgtgatgttccgcttcctgtgtccaagtgttctcattgttcagttcccacctatgagtgtgaacatgcagtgtttggttttttctccttgcgatagtttgctgagaatgatcgtttccagcttcatccatgtccctacaaaggacatgaactcatcattttttatggctgcatagtattccatggtgtatatgtgccacattttcttaatccagtctatcgttgttggacatttgggttggttccaaatctttgtgattgtgaatagtgctgcaataaacatacgtgtgcatgtgtctttatagcagcatgatttataatcctttgggtatatacccagtaatgggatggctgggtcaaatggtatttctagttctagatccttgagcaattgccacactgacttccacaatggttgaagtagtttacagtcccaccaacagtgtaaaagtgttcctatttctccacatcctctccagcacctgttgtttcctgactttttaatgattgccattctaactggtgtgagatggtatctcattgtgattttgatttgcatttctctgatggccagtgatgatgagcattttttcatgtgttttttggctgcataaatgtcttcttttgagaagtgtctgttcatatccttcacccactttttgatggggttgtttttttcttgtaaatttgttagagttctttgtagattctggatattagccctttgtcagatgagtagattgtaaaaattttctcccattctgtaggttgcctgttcactctgatggtagtttcttttgctgtgcagaagctcttaagtttaattagatcccatttgtcaatgttggcttttgttgccattgcttttggtgtttttgagatgaagtccttgcccatgcctatgtcctgaatggtattgcctaggttttcttctagggttcttatggttttaggtctaacgtgtaagtctttaatccatcttgaattaatttttgtataaggtgtaaggaagggatctagtttcagctttctacttatggctagcctgttttcccagcaccatttgttgaataggaaatcctttccccatttcttgtttttgtcaggtttgtcaaagatcagatagttgtagatggctattatttctgaggtctctgttctgttccattggtctatatctctgttttggtaccagtaccgtgctgttttggttactgtagacttgtagtatagtttgaagtcaggtagcgtgatgcctccaactttgttcttttggcttaggattgacttggcaatgtgggctctgttttggttccatatgaactttaaagtagttttttccaattctgtgaggaaagtcattggtagcttgatggggatggcattgaatctataaattaccttgggcagtatggccattttcacgatattgattcttcctatccatgagcatggaatgttcttccatttgtttgtgtcctcttttattttgttgagcagtggtttgtagttctccttgaagaggtccttcacatcccttgtaaattggattcctaggtattttattctctttgaagcaattgtgaatgggagttcactcatgatttggctttctgtttgtctgttattggtgtacaagaatgcttgtgatttttgcacattgattttgtatactgagactttgctgaagttgcttatcagcttaaggagattttgggctgagatgatggggttttctaaatatacaatcacatcatctgcaagcagggacaatttgatttcctattttcctaattgaataccctttatttctttctcctgcctgattgccctggccagaacttccaacactgttgaataggagtggtgagagatggcatccctgtcttgtgccagttttcaaagggaatgcttccagtttttgcccattcagtatgatattggctgtggatttgtcataaatagctcttattattttgaggtatgtcccaccaatacctaagttattgcatgaagggctgttgaattttgtcaaaggccttttctgcatctattgagataatcatgtggtttttgtctttggttctctttatatgttagattacatttattgatttgtgtatgttgaatcagccttgcatcccagggatgaagcccacttgatcacagtggataagctttttgatgtgctgctggatttggtttgccagtattttactgaggatttttgcatcaatgttcttcagggatattggtctaaaattctctttttttgttgtgtctctgccaggctttggtatcaggatgatgctggcctcataaaatgagttagggaggattccttctttttctgttgattggaatagtttcagaaggaatggtaccaactcctccttgtacctctggtagaattcggctgtgaatccgtctggtcctggactttttttggttggtaagctattaattattgcctcaatttcagatcctgttattggtctattcagagattcaacttcttcttggtttagtcttgggagggtgtatgtgttcaggaatttatccatttcttctagatattctagtttgtttgcgtagaggtgtttgtagtattctctgatggttgtttgtatttctgtgggattggtggtgatatcccctttatcattgtttattgcatctatttgcctcttttcttctttattagtcttgctagcggtctatcaattttgttgatcttttcaaaaaccagctcctggattcattgatttttttggaggattttttgtgtctctatctccttcagttctgctctgatcttagttatttgttgccctctgttagcttttgaatgtgtttgctcttgcttctctagttcttttaattgtgatgttagggtgtcaattttagatctttcctgctttctcttgtgggcatttagtactataaatttccctttacacactgctttaaatgtgtcccagagattctggtatgttgtgtctttgttctcgtttgtttcaaagaacatctttatttctgccttcatttcgttatgtacccagtagtcattcaggagcaggatgttcagtttccatgtagttgagcggttttgagtgagtttcttaatcctgagttctagtttgattgcactatggtctgagagacagtttgttataatttctgttcttttacatttgctgaggagtgctttacttccaactatgtggtcaattttggaataggtgtggtgtggtgctgagaagaatgtatattctgttgattcggggtggagagttctgtagttgtctattaggtccgcttggtgtagagctgagttcaattcctggatatccttgttaactttctgtctcgttgatctgtctaatgttgacagtggggtgttaaagtctcccattattattgtgtgggaggctaagtctctttctaggtctctaaggacttgctttatgaatctgggtgctcctgtattggatgcatatatatttaggatagttagctctttttgttgaattgatccctttaccattatgtaatggccttctttgtctcttttgatgtttgttggtttaaaatccattttatcagagactaggattgcaacccctgcctttttttgttttccatttgcttggtagatcttcctccatccctttattttgagcctatgtgtgtctctgcacgtgagatggttttcctgaatacagcacactgatgggtcttgactctttccaatttgccagtctgtgtcttttaattggagcatttagcccatttacatttaaggttaatattgttatgtgtgaatttgatcctgtcattatgatattagctggttattttgctcgttagttgatgcagtttcttcctagcatcgatggtctttacaatttggcatgtttttgcagtggctggtaccagttgttcctttccatgtttagtgcttccttcaggagctgttttagggcaggcctggtggtgacaaaatctctcagcagttgcttgtctgtaaagtattttatttctccttcacttatgaagcttagtttggctggatatgaatttctggtttgaaaattcttttctttaagaatgttgaatattggtccccactctcttctggcttgtagagtttctgccgagagatcagctgttagtctgatgggcttccctttgtgggtaacccgacctttctctctggctgcctttaacatgttttccttcatttcaactttggtgaatctgacaattatgtgtcttgaagttgctcttctcagggagtatctttgtggcgttctctgtatttcttgaattttaatgttggcctgcctcgctaggttggggaagttctcctggataatatcctgaagagtgttttccaacttggttccattctccccgtcactttcaggtacaccaatcagacgtagatttggtctttgcacatagtctcatattccttggaggctttgttcgtttcttttttctctaaacttctcttttcacttcatttcattcatttgatcttcagtggctgataccctttcttccagttgattgaattggctgctgaagcttgtgcattcatcatgtagttcttgtgccatggttttcagctccatcaagtcctttaaggacttctctgcattggttattctagttagccattcatctaatcttttttcaaggcttttaacttctttgcgatgggttcgaacttcctcctttagcttggggaagtttgatcttctgaagccttcttctctcagctcgtcaaagtcattctctgtccagctttgttccattgctggtgagcagctgcgttcctttggaggaggagaggcactctgatttttagaattttcagtttttctgctctgttttttccccatctttgtggttttatctacctttggtctttgatgatggtgacgtacagatggggttttggtgtggatgtcctttttgtttgttagttttccttctaacagtcaggatcctcagctgcaggtctgttggagttttctggaggtccacaccagaccctgtttgcctgggtatcagcagcggagactgcagaacagcgaatattgcagaacagcaaatgttgctgcctgatcgttcctctgcaagtttcctctcagaggcgtacccggccgtgtgaggtgtcagtctgcccctactggggggtgcctcccagttaggctacttgggggtcagggaaccacttgaggaggcagtctgtaccttctcagatctcaaactctgtgctgggagaaccactactctcttcaaagctgtcagacagggacatttaagtctgcagaggtttctgctgccttttgttcagctatgccctgcccccagaggtggagtctacagaggcaggcgggcctccttgagctgtggtgggctccacccagtttgagctaccccgcagctttgtttacctactcaagcctcagcaatggtgggtgcccctcccccagcctctctgccaccttgcagctcaatctcagactgctgtgctagcaatgagggaggctccgtcggcatgggaccctccgagccatgcgtgggatataatctcctggtgtgccgtttgctaaggccattggaaaagtgcagtagggtgggagtgacctgattttccaggtgccttccatcacagctttgcttggctaggaaagggaattccctaccccttgtgcttcccaggtgaggcaatgccccgccctgcttcggctcacgcttggcgggctgcacccactgtcctgcaccactgtctgacaagacccagtgagatggacctggtacctcagttggaaatgcagaaatcacccgtcttctgcgttgctcatgctgcgagctgtagactggagctgttcctattcggccatcttggaacccatctctgctatgtggttcttaatggaagttcgcctagttaaggatatggactctcaaattttttatactaatttatatagcagacgtattcacagactctatttcattttgtatataattgggattacaccatatgcatttttctgagacggtttttttcctttcgattatatgccttggggatcattccatggtagaatattattttatttatttatattttgtggctacataggaagttatattgtaaatatcttataatttatgctttcttttttgtatttttgtcaattatcttcattgttttttaaaataactatcttattttggaataattttagatttacagaaaatttgcaaagaggaaacagtttctatacccatgtcacccagtttctcctaatcgttaacagcttattttaccatggtatatttgtcatactaagaaaccaacattggtactatttattcatttttaattatacaagtaacgcatacaaaaatctttctctttgtgaaaataggcagaataggttcaaattccctttgccctgccatcctaatctcaggacctttattccaatccctgccccaactctatttggtatttatccttccaggcttgtggtagtccattttgtattgctctaaaggaatacctgagactgggtaatttacaaagaaaaggggtttatttggctcacagttctaccgtctttatgagaagcatggcatctgcttctggtggggtctcagaaaacttggactcatgacagaaggcaaacaggtagttggcatatcgcatggcaagagggggagcaagagagaggggaggaggtgccaagcttatttatttatttatttattattatactttaagttctggggtatatgtgcagaacatgcaggtttgttacataggtatacacgtgcgatgatggtttgctgcaccccatcaacccgtcatctgcattaggtatttctcctaatgctatccctcccctaggcccccaccccctgacaggccccggtgtgtgatgttctcctccctgtgtccatgtgttctcattgttcaactcccaattatgagtgagaacatgcggtgtttggttttctgtttggtttgtgttagtttgctgagaatgatgatttccagcttcatccatgtccctacaaaggacatgaacccatccttttttatggctgcatagtattccatggtgtatatgtgccccattttctttagcccgtctaacattgatgggcatttgggttggttccaagtctttgctatggtgaacagtgctgcaataaacatacgttaaccccatgccaggctttttttttttttttgagacagagtctctctctgtcacccaggctggagtgcagtggtgcagtcttggctcactgcaaactccgcctccaagctctgcctcctgggttcatgccattctcctgcctcagcttcccaagtagctgggactacaggtgcctgccaccatgcccggctaattttttgcatttttagtagagacggggtttcaccatgttagccaggatggtcttgatctcctgacctcgtgatctgcctgccttggcctccaaaagtgctgggattacaggcatgagccactgcacctggcttgccaggctcttttaaacaaccaccttttgtttggacaaatgaagtgggagctcacttgttactgcaaggacagcaccaagacatccacgagggatccgcccccctgctccaaacacctcccagtaggtctcacttccaacattggggatcacatttcaacatgagatttggagagaacacacatccaaacagcatcagggcttttctataagcattcactacacacacaaacacacgttggcaatattgaaagtacaatcttttttgtggtttaaaaatataaacagtatgcatttttctcttcaacttgtttgtttgagatgggcttttggggaaaggatgaggcttgtgtggtgagctcaagacacatgcgctgacattatcttagtgtccctgatgtttggtgagtgggatgcaattacaggagtcttgaaattgaggctgtacacagagtcaggcgtggtggctgagctatgaatctgggctgggctgccatttggtttagagaaatttccagtgactgggagaggggattgtaccaggtctaaggcctacctacaagcagaggggctggtaaaggaagttcaggcactttggggagtgaaggcccagggaaatgagttaactccatgcagaaggcacccctggcagaggctagtatgggctaggctagtacttagtggacattaagttgtgcagatcttccctgagcatgtggctttgagtcttaagagagtgaggtcaacttcagcccctacctgctggtagacaggactcctaatgttaaccacaccttgatatggatgggctgcagctaagcttccagattgacgatccttgttttttgtagctgagaagggctgggaagggagaaggctgatagttctgtaacttactcttgtctgtctggcaaagtcttaactgttcttaaaaactgaatttggacttctgcttttgggaggattaagtagatatgcttttccctatttctcttactaagtccaattaaaagctcttggacattacatgtaaaataccagaagactgaaaagtagaaagaagaaggcagacaggctaggcacctcagaatctgagaatgatagggtggtgagttctctgggttttctttttgcctcatccaccccagtcttggagctgaaaaggttggtaatctggaaatgccaacaggcacagaaaaaaccccacaactccaacaaaaacctgctctctctagccaaaacaccagaacagaagtaacctaacaagacagaaaacttttaacaactgttctactgcagcaaaacaccacagaaaagaaccatggcccaaccccacccatgccaccaagggtcagctttggcctagccttcccttctggcaaggctgtgatgaggcaccccaatatccctgctggagtggtgtcagagaaggccgagtagtaatctgggcctttgatctctgttggctgataatgagtccactcacccctccctccacagtttcagtggagaccatatatggagtgcggacttacaccctcacctggcagcagcaaggtttttcttcctctctctgctggggtggtgtctgaagggttgagtggagagtcaggactttcaccattacccaggactaacaaggccacccctactgcagtttcagtggagaccatgtggagatccagtattcctactactactcagcaagcagtatcaagaagttccctacctttggtgtcaacagaagctgagtagaaacctgaacgtccatctacagctagcaataatgagaggtatgggatggagtgcccctccttttgcacctgctggagtggtatcagaaaaatcagttaaaacagaaggcttaaataagatccagaatttctgaaaataatttgaaaatgtctaggtttcaacaaaaaggcatgcatcataccaagaactaggaaggtctcaaacttagtggaaaaagatgatcaatagatgatgctaatactgagatgctggtattatctgacaaagatttaaagcagctatcagatccttcagtgaacagttatgaacattactggaacgaatgaaaaaacaaaaaggctcagcaaataaactgaaagtctcagtaaagaaatggaaggtgtaaagaaataaatagaaatttcagaactgaaaacacataaactaaaatacaaactcagtgaatgggctcaatagcataatagaggaaagaatcaaagacctataaaacacaacaacagaaattattcaatctggacaacacagaaaatgactgaaaaaagtgaacagagcgtcaaggacctgtgggactataacaaaatatccaacattcatatcactggagtcccagaatgagagaaaaaagacagataaaaaataatggttgaaatcattccaaatttggcaagaggcattagctacagactcaaaaaggtgagaaagcctcaaataggataaacccaaagaatcccacaccaagaagcatcataattaagtttctgaaaactaaaaaagtgaagacatcttgaaggcagtaaaaagaaaaacaacactttacctatggggagaaataatttgaatgacagcagatttcttatcagagaccgtggagtcaagaagtaagtggcacaatatttttcaagtgctgaaagaaaagaactgtcaacacagaatcctatacctaatgaagatatctttcaggaataaaggggaaatcaagacattctcagatgaagggaaaggaagataatttgtcataagtggcatagcctaaaagaaagaccagaggagtttctgtaaatagaaaggtgataaaagaaggaaacttggtgcatcagcaagaagaaaagaaaatgcaaaaataagcaacacatgggtagaaacaagagacttttcttgccttgagttttctaaattatatttgggaattgaaacacattttatgttttttatttattttattttaccttttttttgagatgaagtctcactccatcacccaggctgggagtgcagtgggacaatctcagctcactgcaaactctgcctcctgggttcaagtgattctcctgcctcagcctcccgagtagctgggattacaggcatgcaccaccatgcctggttaatttttgtatttttagtagagatgggggttttgctatgtttgccacgctgttcttgaactcctgaccttaagtcatccgcctgcctcagcctcccatagtgctgtgattactggtgtgagccaccatgcccagcctgaaacaaattttaaaaccctgtctgttgtggttctaaatgtatgaggaagaaatatttaagaccattataaatagggaaataaaagaatataaaaggaaatcaagtttctacacctcactcaaactggtaagatgatgacatcagtagacttataagttatgcatatgttatatttagaacaactattgaaattatacatggagacacactcaaaaataccataaacaaatcaaaatggagttataaaaagtgttcatatcgctcacagaaaggcagaaaagaaaaaacagaaatgaaaatcagagaaaacaaaaagcaaaatgtcagacaagccccagcatatcaacaattacaataaatataaatggccaaagtatgtttcattctgctgaagcaatggctagagttgccccaaaagtggtagcaaaggagtccccacaagggagtacccccaaagtatcccaagatggggccagttgggattccaaagaaagaagcattaaatgccagggtgatcagttcaaggcatttattaggggaacttacagagcactacagcatatcctcaggtggacagtgaaagaaaggtatgttatacctaggtatgcctatgccaagaggatcagggcatggagttcatatgaggatttaattaatttggctcaaggctgggaccaatttctttcagtgttttaggcaacaacctagatacctttattaatgcctgggaatgttcaaagccttggcttcggttcagccttgctgggaaaaacatgcaactggctgggtcacagagccaacaaggcactccctgtttttcactcagaatgcacaaaatggggggaatgggagaccctacaaagtacaacaatgaaaaggcagagattggaagaatggattaaaaacatgacccaactatatactatctaccagatgctcatttaaaatataacaatgtaggcaagttgaaagtaaaaggatacaaaaagatatattaataaaaagaaaataggagtggctatattaatattagataagacagacttcagaagaaagaaagataccagagactgagagggacattatataatgatgaaagtatcagtccactaacaacacatagcaaagggtagtgtcatgttgaagaaacgtgtctatgaaaatttaaagaacaacagcaaaaccatatctactaaagctaaacatattcctatcccatgagccagcaattccagtcttaggcacaagcctgagagaaatgtgtgtgtgtgtccactatgcaccaatggtaaagaagaacatgctcatgatagtattatttacaacagccccaaactggaaaaacaccccaaatatgtagcaacacagaatggacatatagattgtagtgtattcaacattgaaatactatacagcaaggaaaaagaatggcctcatatgacatgcaaccacatggatggctatcaaatgttatgttgaatgaaaaaggccgggcaccaaagaatacatatatactgtatgattgcatttatatgaagttcaaaagcaagaaaggaaaattaatctatggtatagaagtccagttagtgattccctctgattgtaaaggggcacaggaacccttctggggtaatgtattatatattaatctcagtggtggatatgtaggtatatacataggtcaaaataaattcactctttttttttttttttgagatagagtctcgctctgttgcccaggctagagtgtagtggtgtgatctcggttcactgcaatgtccacttcccaggttcaagtgattctcatgcctcagtctcctgagtagctaggaccacaagcatgcaccaccatactcggctaatttttgtacttttagtggagacggggtttcaccatgttgcccaggctgctcttgaactcctgacctcaagtgatccacctgccttggcctcccaaagtgctgggattataggtgtgtgacactgtgcccaaccaaaattcaccaactcttcagatttgtgtcttttatatatatattaaaaatgtaaaaagttacaatacaagccagattctggtcaagtaatattaattatttactttatgccagacactgagctgcagacttgcagtacacatgacactgggcacctgcctcagtttctcttctgcattatgatttctttctgaatctgggtgtctctctagtcattgactgggcttctgctccattcttggtcagcagttcatggatatcctgtttttttttttttttttttcccatgaatattgcttctgtttgaggtcttcccattccagccccagaactgggtccttagcccaatcactacagcttgaacagaccacctgggacattcagccttttgtggagggcccccagctcagcttgctgctcccaccatctctgctttccctcatttttgcctctaggattctcccagtctagtacctgcacacacatttgctggatggatgtccctctagatgatgataaacacctctttatggcactttgcagagctgctctctcagcgatgggcatcagcatgagtatagctgaaagctgagactacttctcttatgtcccctctcacttctcctctaatgagcctccctaattttaaaggtgctatttcctgggtggttaaaggaagatgagagttttattaaggaaaatgcccaagtatcatcgttgctagggaatccacctgggagtctttgctgcaaatgtgcctgtttgtcatttcatgccttacttggggcactgactttgctgccaggaataccaaatctgtttttcctaagccaccactgggacagatagctgggaagatgaccccactaatagcccattagtatacaaattcaaaaatgattcagcagttcagggataagagctccatgtgggtgcaaacacatcctcaggcttggctggggcacaagattgcagccttggtcttcagcaggcaaggccaggtgctttgctcctgaaacaaatggatcaatgtgctggttattgctaacaaagtactagttgggcccatttgtgggttaaaacagccatctctagactggtgggcccaggatccttgttcttaattgatttctcttgcttttcttgtggaaatgaagtaagaagttgcttattaaccaatttactttgaccattttccattccttaaccaacctgcaataattcgtagcatttctggaacaaaagcagcagagggctcctcctgagttaatattggtgaattacgtgtccaagatagaatggtttttggttgtgcaggttaagaagtaagccttacatgctgcagggtgttggctataagtaactgctccttttatggaagtcaaagaatgcctatctcctggcagtaatctgttccctgttgccaaggtaccagggcactgggtataacttcaggagatctgggttctggtctcagctgtagcattttctgccttataaccttggacaagtcatagaaagaaatgttctagagttgaaagagctcatctatggctcaacccctctgtatcaactttgcttacccatgctgtctttgcttagatgtttccaagactcactactgagaagcctacttcaatagacaaattctgaatatgaaacataaaatggagtttgttcattcttttattaattggatgttggctgtacttgtaaccacatctccaggttcactgaccttggagcccatggatattcacatcttatccattgcatgaaggcggtctctgtggaatctttctagaaacttgtaagacgggacttgtccacaaattagacttgctcagtgtggctatcagggttggccaatctggagctttgtatctgcattggagtgggcaacgcaggccttctgccttctgcttccacatcacggccttgaagtgctgggttgtgtgcaggaatgaatgaccctcttcccgttttgtgctgcacttttttgtttgtgtcttgaagatgcaccttctgtgcccagatgttcatcacatcttcaatgaaggcatctcttttatcttccaaccttgatttttctttcctcaggggctctggcctgtatccagtctacctttgcccatttcttccctctcccccagtgaaagaaaatgtctcccttcagccaaaacaatagccaccgtgcaagaggcttgggcaagttgtcttagagaggagggaatactgtctaagctctgctcccgagaagccactgactgtcagctctggcttggtggactggacactgtagtagtgagtagagtgcccagaacagtacttagtataataggcccttggtaagtgacagccaatatggcagcctcattcccatctcccaggcctggtgtaagataatgtagatcctgacgtatggacaggatcaaaggcaggaggtgtcctgagaacatgaagtgggcccaggattggagcagcctggaagaggggaagactcactctgggaagctccagcttgccttgttcccagcagaagcagcaggtggagcaatcggcaaagatcattccctttctccctgtgcacatcttccctctagaaaccactgcaattattattattattattattttttgagttgaagtctcactctgttgcccaggctggagtgcagtggtgcgatctcagctcactgcaacctccgcctcctgggttcaagtgattctcctgcctcagcctcctgagtagctgggattacaggtgcccacgaccatgcctggctaatttttgtatttttaatagagatgaggtttcaccatgttggtcaggctggtcttgaattcctgacttcgtgatctacctgccttggcctcccaaagtgatgggattacaggtgtgagccaccgcggccagccgaaaccactgcaattcttgaatctgagtccagcgggaatgatgctcaagattgggccactatcatccagagactggcctcatggaagatgtgacactggaaagagctatgagtatgggtgagccattctggggcttgttgaactccaggtgaggaggtgaggaaccaggatgatggcctcacatcctgctctactctatctcactccattctgggctgatactcccagaagctctggcaatagggtctggtgctaggttggaaggctatgtggctttctcaggggggccagagagagaatctaaagttgagacaggatgcaaagcctagagctgggagatggggtgcagattattgaaccaggagcaggttgaactgtggcatgcatggtagttgagggtaagctgttgaggaccaggacagcgaaggggcaagattgtgttggaagcttctttgtgcattctgtgggcaggagtctgggtcagcctgaatggttattggagtcatgtagggatgggcgctttcatctgattatcctacaatcagatggatttgattctgcatgtttccaaagacctgctggatacccccacatgcacatcccatagccaattccattttatgtcttgatggtatatattctgccctttctcacattttctgtcctgggaacggcactaccatttaccgaattgcccaaggcagaaacttttcccttccttaccatttataatgtcttctggtctgtttttcttcctaaatatccttggagactatctcctgtcctccctactcattgcctttatgtcagtcagttctagtgttttctccctggggcacaacatccacggctcccgagatccttctgcttctgcccagcaaatccaccttccatggggtcccatttctatatcccaaccttaggcatgccacttccttacctagaatgaatccttgatgtcttcagggtaatgttcagaccttgcaggacccacaaaatcctccacatgagttgctgaagtatctggtactttctccctccactttcccccatggcttcctcttccaccttctcatcatagtggataaaatttattgagcatttattgtgtattgggtcctgtgcttggagctttacaaatatcttgctgattcaaagaacaaccccatctgtaggtcttgtgctttgaccaccacgtggaacccctccctgctctccagctctgcaatgccccaaagctccatgtcttttggaaggtatacagactttgtatcagatttactttacttaaatcctcactcagaagctgtgttaccttgtgcatgctatttagcttttcaatgcctcagtttcctcatctgtaaaatgggagtaatgatggtacctaccttgtaagagagcccactgcagggggttgttgtgagacatgtaggagaaaatacctgtaaagggctcagcctggtacctggtgtgcctgtagtacttaacaaatgccgagcgtgacaccgcgtgctttggataccctgtcttccttctggaagagtcctacaccaaccagacagtcaagtcactgccattcttcaaggtcattctttcttcccaagatcttgtacaacttccgcaggctggaagaggcaccctccccagtgatcttggagggtctgtgttacctctaacatagcacttacctccctgggagcagttggggttttcttgtctcttgagggcaggatctgtccttggccatctgtgtgcttaagggccaagaacagcatttgacacagagctgggctcagtgagtgcttgccagtgggcaggagctagcaagtgttcgtgagatcctggatggtggaggagtgccttccacgtcagctgtttcacggtgtgccctgtgctacaacctgacgtgtgacaggagaacttaggaggcctgtcacacctctgacctcctgacagatttagtgtaggttggggctgtctgtatctcggatctccccccatcctaccccagcagtagagtcacatttgcatactgcagccatgatcaagttaaaagaatagttgagatgaaaggagccaaaagccaggtctcttgggcaatttctctggtaatgcaggaacagaattatccaaggagtgattgacaaattagaagcactttgcacctaattttaatgcatttggctccttgagaggaggaatatgttaacttaaaattattcaccttgcagtagcttctgtctttcaaatcaaaatcaatcttcatgtggggtactaaatcttaaggaaacaaattgctttctatggtacattgctttctttaaatggctttatttggagggccagctgagcaagttaatttcagtggcacagctggctggcgattgtggagtaggcattctcccatgtagttggagggagcttggtctggtgctcattaaccacccttggattaaagaaacagtgagtaattggcacatacataggaccatggggtggaaattaaaacagtttcgagacccaagttgttgtgttgatgtacaagagtttgaacttggtcctgggaatatcctttttttctctctctcagtggctcccaaatagctgcttctgtaccttagggccacgttatctctctcatcaaccattatggaaacctattcctggaaaaggaccacatagactcattcacatgaaggtgatcataactgatggcagcttgaattgtggtataatctttaattttttttttttaatttcaaaagaagatgaagccaaagcagttaatctcgaattagaaattttttggcaagaactggtgagtggagacctgctgccatccccaagggagctgcctcccctagaatcataacattctttagcaagaaggaaatagaggtttttctagttaaatttcttacagaatgcagaaatttcattacagaatactttaatagttgttcattctttgcttgaatgccttttgagatggggcactcatggcacgaaaaagcagcccattttattgttgggtacttctgatttttaaaaagttacaccttattttcaactaaaattgggctccctgaagctgccaccatagttccgcactctagattccagatgtcttctaaatgacagctcttgccgggtacagtggctcacacttgtaatcccagcactttgggaggctgaggtgggtggatcacctgaggtcaggagttcaagaccagcctggccaacataatgataccccgcctctactaaaaatacaaaaattagctgggcgtggtggcgggtgcctgtatcccagctacttgggaggctgaggcaggagaatcacttgaaccagggaggcggaggttgcagtgacccgagattgcaccactgcactccagcctgggtgacagagcgagactctgtctcaaaaataaatgaatgacagttcttcacatgtttgaggataactccctagtctcatacttcataacatgttatctcttcttagggttaaacattccttattctttgaactgtcctctcactacataactttcagatttgggttctggctattttccttgggacatattccagtttgttcccattcttcttaatatgcggttaatgcagtttctcttaatgcagcctggcttttagggaggagattatctctcatccacaaagctttgaagctgagtctgcccattctgtggctgtgcagacgctttcatggtctcccaggcaggactttgtccttagccctgttaaatttgatttggcctattctggttatcactccctccatcctatgtgtcttctatccctctcagcaacttgccattttcacatttgatgagctttcttcctgacagtctctctgatgagatgtgaaaggctattaaggataatttacttagaagtaagaggcgacagtggtggcagcagttttttaaaaaacaactcattttataagtcatgtatttaaaatagaaacacaaggaaaataacaattacctataaaaagctattttttgcatatgtccttccctatacacatttatccaaggattcatattgtatattttgttttttcacttaggaatattttccaatgttactaagcagtcttctataagtccatttttaatgcctcccttatacaggaaaaatgataattaatcacctattgttggggatttaggttgttttccaatttttccatcttgtgaaacatgctgctaggtttttgcactcatctgtgataagtttctagagatggaattgccgagggcaacaggtgggtacagtttttgatatttgttgtcgaattgcacttcagaaagatcatgccatatgaaacatactattttatatttctaaaagcagcatgttgaagattttgcttctgcagttgtttcaagcagagttcttggcaatgtggacagtgcttggtagtaacacattcaaagagaaaaggtaccccgcttttaggaaccccaaattagagcaatactgatggaaagaacaatagaagggacccaggaacagaacaaaatgcctaacttaaaattctgttttaaacatttatttctgttttctactttgttatggaatatgctttttattttaggctgccattttaataacgtttacttctttaaagtaaagaccaatatggtgaaactccgtctctactaaaaatacaaaaaatagctgggtgtgatggtgtgcacctgtagtcccagctacttgggaggctgagacaggagaattgcttgaacctgggaggtggaggttgcagtgagccgagatcacaccactctactccagcctgggtgacagagcaagactctgtctcaaaaaaaagaaaaggtcaggtaccttcagaaactgatacctgaaggtatcttttctcattcaagccacatgataggatttgccaggatgtgacaaatatttcaaaattcacaccccagatcctgggatctttgacacagtaacctgaagattccttgtgtaaaatgtaccaaaatacctgatcaattttactcaaaacaagtactaatttctggttgtatttgtagtagaatcagcttgaatagtttttagattcttgacatataacatagttaagtggatcctccaaactgatatctgattttttaaacagttttgcaaaagatgtggaatacactgattccaactaaatatagcaggtccaatctctcaaagattgcatataaggcaatcagacagctgctgtcaaaggaactgatgcttctaaagttccaaagtacgtcactaaaatctaaatcacttcctcacacatatacaaaactttagaattccatagggaaacagatatttattttagccataaaactctaaagatgttctaatttgttgtccatctgaccacaaaggcgttgtatagcagctggttttgcagttggttgcatgtgacagaaacctgactacagtgttttaaccaagctggagttcatttcttttacataacaagaagtccagggctggtgcagctgcttgaagaagtttccaggaatccaagtgccatctaattgcctggtccatcatctgtgtaatgagattttttttatcctcctgtttgcaagatgtcaagtagataggggaaaagctaaagctgtgtgcaagctaattctgttcctttttatttaaaaaaatctgttttcatcttactgcctcaaacaaggtccacaggctacctcctagctgcaaaggagtctggaaatatgaaatgtgagtatttttaaattgaggttattaataaggttgaatggggagaatgtgttggaaaagtattagtctcgggacttgaagtcatttgtcttaatttcagctctctcacttgcagggtctgcaaacatgaacaagtcacccttttatctttggcttcagtgtatcatctgtgaaatgatgaggttggagaaaatgatcttgagagccatagggtacaggagctggttcatatcaacttatgggagctgactgtgtacttctcatcccaactctgagttcagcagtgtcatgttggtggcctgaaattggcattagtgagagtattttacaccatggaaattagcaaatgctgcaaatcagggtattcccatccactccctccctaagaagtttgttaaacatttaccactgtctgagaggccttccagtattaacagcctctggatatatcatttcaattttataaatcagagtttcaaagggcaatgagaccttactccagagacttctaagcctcacccattcatttttctgttttatgtctctaggtttctcatatcgtccccttctccatttccttcaatccttgctttctgcttttttaccttctcctcactctgtctcagagaccatgtcatgaaatttagaaacaagtttatttgttatgactatacaccaggcttttgtgtttctgattgtcaaatgagaatctgtcaaatgtctaatgtgatatgcatttaatctaaatatttaaaaaacaaacaccacttctttctttccaccattacacctgaagttgatttttacttaagtacaaccctgaattacttttcttcctagtgtatttttttaatgatcaaggattacttttaatcatctgctaatcaacaatatgattaagtattttttcaattttgtcgacagcacagaattggaaattgacttaccaaaggcttggttgccatctcatcagaatcattaacaatttttattgtggagtttttaattaaactttttattctgagataattgtagattcacattcagtcgtaagaaatcataccaagagatacagagttgtgagaataatacaaagtttacattctgccaaactgtggtacaatatcataacaaagatactgacactgatatatcctagtgcatctaaaattttcaatcaaatatttaaggttctgtaacatggttttggatatgaaagggagtgtacctcccacaaaggaaacaattattattattcttttatcttttaaaaaatgttattttaatttttgtggctatatagtaggtatatatatttatggggtacatgagatattttgatataaacatccaatgtgtaatagtcacatcagagcaaatggggtatccatcaactcaatcatttattctttctttgttccagaaacaatccaattatattcttttagttattttaaaatgtacaataaattattgactgtagtcaccctattctatcaaatgctagatcttattcattctatctaactatatttttgtttttgtcaaccttccccacttccccttcaccctctaaccctctactacccttcctatcctctggtaatcatattctactgtctccatgagttcaattgttttagtttttagcttgcacaagtaagagagaacatgcgaagtttgtctttctgtgcctggcttattttacttaacataatgatctccagttccatccatgttgttgcaaatggtaggatctcattctttttatggctgaatagtacttcattgtatatatgtaccacattgtctttatccatttgtctgttgatggacacttcggttgattccaaatcttggctattatgtgtagcactgcagtaaacatgggagtgcagaaaactcttcaatatactgatttcctttcttttgggtatatacttaacagtaggattggtggatcatatagtagttatatttttagttttttgaggaacctccaaactgttctccatagcagttgtactaatttacatttctagcaacagtgtacaagggttaccatttctccacatcctggccagcatttgttattgcctgtcttttggataaaagccattttaactggtcattgtagttttgatttgcatttctctgatgatcagtgatgttgagcaccttttcacatacctgtttgccatttgtatgtcttcttttgagaaatgtctattcagattttttgccttttttttttttttttttttgagacagagtttcgctcttgttgtccaggccggagtgcaatgatgtgatctcggctcaccacaatctccgcctcctgggttcaagcgattctcctgcctcagcctgccaagtagctgggattacaggcatgtgccaccacgcccggctaattttgtatttttagtagaggtggggtttctccatattggtcaggctggtcttgaactcctgacctcaggtgatcctcctatctcggcctcccaatacaggtgtgagctaccgtgtgtggcctttttgcccatttttaaattggatgattagatttttttcctgtagagttatatgagctccttatatattccagttataaatcccttgtcaggtggatagttagcaaatactttctcctactcggtgggttgtctctttgttgattgtttcctttgctttttaacttgatccagtcccatttgtccatttgcgctttggttgctatgcttgtgggaaattactcaagaaacctttgcccagtccagtgtcctggagagtttccccagtgttttcttttaatagtttcatagtttgagctcttagatttaagtgtttaatccatcttgatttgatttttctatatggcaagaaattgtctagttttattcttctgcacatgaaaatacagttttcccacaccaaggaaacaattgttaggcccacagcaggtgccaaggggtccagccaacttccttcttctgtttaaatctgtccccatcttttctcttcccagcattccacagctgggtcttttcttgctcaagttggatgaaaaacaaagtctaatatcttattcctcaaagacatggttttgagaactagcagcatgggtaccaccagggagcttgttaaaaaagcagagtcttgagtgccaccccagccctactggatcagaattcgcattgtaacaagctcccaggtgattctcaagcacattaaagtttgagaagttctgattgcatgttctcagtcatatgtgaaagctgaaaaaagatgatatcatagaaataaaaagttagaacagaggatactagtagctgtgaaaggtaggggaaggagagatagggagagatttgttaaaggatacaaaattacagctagataggagggtaagttctagggctctatatcgctatagggtgactataattaatattatatagtttaaaatagctagaaagacattgaacaaccccaacagaaaaaaaaggtgaatatttgagatgatggatatgcaaattaccctgatctgatcactacacattatttgtatggaaacatcactgtgcaccccatgaatatgtgtaattattatttgtcaatttaaaaaatgaaagaaaagaaagcaaagataatacagcctttaaaaagagaagttttggtgtaatagattactgggctatcttctaagtcagacgcatctttctcttggggttctctaaagaggtccacctccaattctaaacacctcctcatcacgagaatctatcaccagttctacggagagaaccacagagtcagtagacctaggttaccaccgtcttctatcaagtctctctccctcattgagcccagggaatgtaaggatgagagatttccctccttaggactgatccatattccagtaagcccagggttccgtctctgaaggggtgattaagggaggaaatctggcagcctgtgagagtactccttcatagctaccttgaaggtgggagacattgtctccattcttgctttgtcattcataaattgatcaagctctcctagtcgcatgaagccgtttcttcttctggccttccgttttttaactcttctgcaaagagagtgaatgagaataaatgtttgatggctacctgctttgtgtcaagtgtcaagggctttacttaagtgatctcatttaaatcttgtctcccactgtgtaaggtaaaccctatcacatcccttttgcagtcttgaataaaaaagagacttaaaaaaaaatactttgccaaacatcatacctaagtgaaaagatgtgattttcctctgatttgattttgaggtttctctctgaagaatggctataaattctagtcctgtcctgctggggctccaggggaggtatttgtggatgtttacagaatgcctttcatgggatgcttcttcccagtagacagcctaatgcctaagcgtccaacctgtgaccaggtgttcctctcacaggaaacttgttttgtacttgcagacacccttgtacctcttgtctgacgtgttcattttattcctaccatgatagccactctctaggagagccctgacatggaaagaacttaggttcagattgtgggtcaggtgagacatagaggagacagcacaaccaaacaaatgtaataacacaaacagttttattactcgcagctcccagagagaagagagcagcacactttgcagggccagtgggaagacgtgagctatccagagcgtgcatgctgagccagcaggtggagagaaggagggagggggaggacttgtttataggaccctgggattgaccattagggtatttttgtggtcagccactgtgggatgtgttgtgttctgaatcagtgaaatgaggaacaatagagtatatcacaaaccacatagggaggggaagttttaggtaaggcaaagggaattgggtccaactgtgtttcaagtaacttatgtcgagcctgaaaatagatgccaaggcagcaactacattaaacaaatttatgacagaagataattattctgggtgggtagaccctgaaaaaattatccttccttggataaaatcaaagagcacttcctctgaccttggtctttttaacttctcacctgattacagctactgggctttcgttagcaatcttgtccatgcccacagcatttgaggttaaactaagtactttctgcgttctgtttcatttagtcttcataagatccctgtaatattgcttttatcccatttgtcagatgaggaaaatggaaaatgagacctgccagaggagcgaaagaagttgttgaaaatctcgcagaaactatgtaggcaatacccactaggatgactataataacaaaagacagatagtaagaagttggagaagatgtggagaaattagaaccctcatacacaggtggcatgaatgtaaaatggtacagccacttgagagaagtctgacagttcttcaaatagtgaaacatagagttaccatatgacctaacaattccagtcctagatacatacccccaaatgaaagaatactgccacaaaaacttgtatacaaatgtttatagtttatagaagtattcatgatggtgatcacagcaggagacagacaaattcctaggcagacagagatgggtcctggtgaaacccaaccctcaagccaaagacagcctgaagcctgaaaactaagccatttgccaagctgtgggtggcgggaacaagcgagagctgcgacatttcttgggggcttggaccttgggactccccacgtgagagctgtaacaccccttggggctccacaattgctggcatctccaagttttcgggcaccactgtgttcccctcatctagacggcagagtccaatccagagatcgcttgcggtacacccagtccaggcgctggctgagcgtggatcctgcagcaagtgtgggatctgggccaggatgcaagcggagtgcagcctgccaggcccagtgggcagagtgagcccagcaggcccaagcaaggccctaggcagtggtcatggcggccacagagattttcagctggggaaggggcactcaaggaattctgtaacactgtaaccctcccttccactcgctgagcgatgggtgagaaaaagctgctgggtgccatttcctctcgctcactaaaccacaaaagctgtaataatagccccagatggaaacaacccaaatatccatcaactgatgaatagctgaacaaactggcatatccatacaatagaatattattcagccatcaaaaggaataaaatattgatagatgccacaacatggaagaaccctgaaaggattatgctaagtgaaagaggccagtcacaaaggatcacatattgtacaattcaatttataggaaatgtccacaataggcaaatctatagagatagaaaatggattagtgattgcctagggtttgtggggtgacggggagattggaggacagtgaaagcaagggatttctttgtggggtaaggaagtattctaaaattctggtgatggtttcacaacttgaatatattgatagccattgaattatataatttaaatgggtgaattgtatggtgtgcaaatatctcaataatgctctgaaagcaaacaacaacaacaaaatgaaaataaaaaacaaacgtgagagtcagtgatccatccaaggaattccctaaatgttctgcatttcttctatcaaactccaccaagctgttaaatcagtggttcccagcccaggatgtgcactgataccctgatgcctagagcccctgatgaatgacagcagaagcttggggcggacctggacatcaatatatattatagctcccaggtaataccccatgtgcagccatgttttttatggagaagcttttctaccacaagtctctgttcagaggctgtgatctacatggaatctaaaagatttggcatgaaattttgatcaaagcaattacctatatgctttttcagtggaggttgtctgaggtgtagcagtcagagaaattgaactgtcaaaaacgaatataagaataataagagaatatttcttcttcattggacacccaagatgaatagcaggtaaaataaaattttaaattaaattgaatatgtatacgactttacttttttgttaaaggactataacatgaataatgaacatattaaaaagagaagaccagaccctcaatttctttcaataatgttagtgttgtatatcctagcttgaataaaacacatttcattaaaacacccacacggttctgcaatgcattatggatggcctctctggagaaatcttacatgcctttcaatttcgacatagtgatatggtaataataaaagtctttggcatataattctgcaggtatttttacaattctgagttttgctgatcaaaagccagggtttacctcacctgggttctgacctgcagtagattgggagaagtgaatggggcagaaaggatcatttttgttccccatatttgtggggttgttgtatcaaaaatctaaatataaatgtatttgaaattgtattagttgagatagagtttcagctgctctatcaaacactcaaaatgatagtggcttaataagtaagaagatggtttctctctcccataaaagtccaggtgagtgtggctgctctgttctttgctagggctcagcaacccaggctgtgtctgtgtttgcttctcctttcattcctaacatactgtctctctccatatggtccaatatgacccatcactcccaccaccatgtttgctgtgggaagagagaaaggaaagagcagagccggcctcttctgtctaaaaacaggaactggaagtggcacatgccacttctgctcacatcctgttggccagaacttaaccgtcttaatcatatgacctcatctagctacaagggaggctaggaactgcaatattgattttagatggccaagtgtccaactaagagtcaagagtttctattactatagaaaaaggagaacatgggtattggggaataataagcagtttctactgaaggaagatgcaagggcctataatatcatggatattataaaggtaaaatgaatttcttccttgcagtcatctagtaccatctctccatcatctaatgaggaaataggtctattttagtgcctttgcctcctccaatcctcattatcacagggtcctactgacacgtaggttcaacataaatttattaaaggcccactctgagttgagtgtatagtggacctttaggtgctcatgacaatcccataagatagctattatatctatttgccaatgaagggaagatgactcacagaggttaagctactctcccaaagccacacagctgactgaggttctagtatctgctgggtctatactgggggacttcctatattagggacttcctagttttcttcctgcctcacaatggggcagggagaagactaggaagtgctccccagaagatagtgagttaggtctttaaggagaccacaccagggagatgggggaggagtggggtttaggaggagggagcagcaggtatgcagggcatagcaaggcacttctgtagggctacaagcacttccacaggtggaaaagtaggatgtataggggagtaatggggatgaagtagaagaaacaggcagaagccaattgagaaggacacctaaatggccttttgtagccaaaggagagtcctgaggggttttaagcaggagagtgatgtggtcagatttgccttctataaatctgcctagaagtgaggagatcagctgggacttgacaagatttgagcaaggaatgaacacctcaatggtgcaaattgcgtcttagggaaagagtcaatagatacgaagagttaaaattatagttctgatcttatgtgagggtgagggagagacacaattacaggacaactcctaggatgacccagggtttatggtatggatgactgagttgatgttttcacttatgaagaaagatttaactagtttctctccaactgcaaaaataatagttctaaacatcttcatggcagaagactgtacaattaagaaatttatgggaaaaatagaatggggggaccagggtagttaaaaacgtatgaatgttcttataggtacattttacacttgcaatattaaggtgataatatcctgaataaagataatgtcagtgacagtttttgtatcttaaattggcaaaatagcattaatagttactgtatcattaacttccacctactatggctctctggaaaattttggtatcatccttctgtatagttttaatggaatatggatttgttttgctctgttgaagataataagcataccaagagacattttcttttagtgcttgaacctccatccaaatgcttaatgcctttctgattttaagatttggactgcctaagtcaccctatctaagtcatgactcaaaagtaattaccaagtcacatataaacatgatcgaaaattcacacagctgcaggagagaaacagagaaagaagtccatccatgcacaccagaattttgagtaagtggagattgctccaggggagggactgctgctggtcaggaggaacctggactgtaaaggtagaagtcactcttgtttctttctggttgattgtgcttcatgccacagcacctgttcatgtgacttcagttgtgtgctcagtccttcatccaggtaggtcccactgaagtggacagaatgggagaggggcagcttgagctgcattctcagggtcttgcctccaaagcctatcctggctgagctggcctgacctgatgtttgagccctgatcatggctcacctgccttgtttctcataagtggaacttcatcataaaggaaggggaacagcttgggctctgccatttgctgactgcgtgaccctgggtggatggttcagttgcacaggctgttctctggggtatttcaggaaagccatagctgtagactttttatgtaaaagcagttcagggctgaagtacagtgggacttgaggcaaaagtggctagtggacctgtcctggacctgtattaacatggcagactctccatctctccatttttagtttccttatatgtgcaactccaatgaaaaacacaagcattttctaaagatgcatttattcacagttcatatgagattaaggaaagttcacgtgtccataccaaagaaagaaaaataaccatatgaagttatatcagtagataacacaagaaaatattgatgttcaccctggttttataatgcatatattatggccaaaaaaatacaatacattcatcctaccttcaaaaggcttagtgaggctaaggagttacagcattgtgattctttggttattgtcagaaacaaatgcttctgtgactccagtgtaagctcttatctcttgttgaatttataactaattcagtttgttttgacaccactactggtattcttcaagaaagtttttgttagtagcagggaggaaaaatatgtcacataccatagaaatcattggcaaagccatgccgatgcagcatagcagatgggaggcaaggattgggtgggtgggagagtgagtgctcccgaacccgagggggttattggaaggattaaatgaggtgatgtctgtaagatgtctatcttggcgactagtatataacagtggctcagtaaatggtgtctatgattagaattattttttcaagatccattccttacttcaatcaccagtttgatacttagtctcaacccttaatgatacaaatagacatagccagcattcccaatcccaaattctttgccagtttcttaagaaagcatactgtagctccacttttgaagatttgcaatgcatatttgaataataaaggctctgagaagtcctgcatgaaagaaacttgttgacttttgtgttgccttgtattttccaaccttttcagacccattttttttcatggactgcctattggcagtttttggcacaagaattctatggaacaccctatggcaaaatgatagtctcacacctagcatttcttcgaggtaaagaattctagacagtgagtcactgaaaactttttaggagaaaaattaagttttcttttcctcatcaatcaaattaaagtcacttgattttgtgaacagtgttttgtgacagatgaagctatatattcagacttgactgatgttactgatttctagccctggaggtcaagggagaggcaagctggggtaagacaacaagctacagattggtctgggcattgcttggcaattatccttaaattattcttcacaccaaagttcacactcgcgtttactcaaactcatcttctttgactcaaaaacagccataggaagtaggcaggataggaaatgaccgattccatcttatatccaatgaaactgagatgagcagaggtgaagcaatttaaggcgaaagagctagaagtagaacttaagtctcctgactcaatttaattctacaagcatttatttagcacctactatgtgccaggtacagtgcttagattttgggagtacagggtgacaaaatcaaatattctgcagaatttagaagagacatgtaaaataagagttacaacataatgtgaaaagtgcaatagtagacacagggaggatcagaatggtgagggaagaacaaaagaaaaggtggtttatgaactgggttttgaaggataaataagaccttttccccaggaaaacaagcagggaaagacagaggatatcgctataaaattgttaatgtccctctccccgataacccccatagcaggtgatggaccttagaggatattagttgtgtgtgtgttgtgtgtctaggctctgagatagtaaaatcctgaggatttccccttcattcctttctacttatttttgaacaaagttggaggcataaatgttttgcaaggaccgcgtcgcattacagcatgacgatggatgggagaaattcatctatgaggttaaagtttacaactttaataaatcaaatctcttaaacttgcgattgaaaaactagcaaaagggacaagattctggcttctggctgcccacagttctatttcatttgctggctggggaaggccttttccctggggcctgattggcagtgactcctgcagtgtttcagcccaaagttcccttttcttgattaatgtgattttctatgttttcctggtagctcagaaccaatgaagagcagtgatctgggaaaccacctcctgtgattccctttgacagggttctcagtggaacagaacaagtaattttggttggcatcccggaaggttgcctttaagcagcagcagtggcagcagccaaaggagcccgataccacctcacctggaccttcctgcagtgcaggaggctgggtggtgtcaggatcactgagccagatacaactaggttgtctttggctaaactggtgtgcttttgcaagcatgtgtagatagattcctatttaaaagacatctcaccatgagaaaaaagtcagaaggccagggcagtgggaaaatgatcagtgcatctgaggattatgaaggggtgatgggtacaacctacagttgctcatggatatttcttttcctccccacagagggacaagaggataggtaacaagaggcctccaggtgccaggcagcagtggctgtactttgtttctctgtggatggaaaatattctgcaactcagggaggtggccagagaccaaaggactgcctgaagctgggcagcaacacaggaagggttgcttttaattaaagttctctttgttttgttgcagcgcctaagaggttggcgtctgagaattttgtcctttaccttcttagaaaggactctcagtcttggccaggtttgtgaaatgttttcttgtaagcacatcttcctacctaaactttgaaagggaggatttattcagcttttgaaggaaactggctaaaatttggtcagatgacatcagccctgccagccagcctgggtatgcaggtcgttccccattggactctctcacgccttcagatgcattttgtacatgccttcatctttctctgtgtcctgcgaggctgacatctatagattgtttaacctgcgctcccttatcttctggcttctgcttgggtttggcctataagtaaaggagagagggtaggaacagagagattcgggcacagattccggattccctctctgcctgcactggtgcgtgcctctggctgtggttacactcttccatgtctactccttggttgttcccaccacactgggcttcacgattgctatggttatatcctcctcttgcttcttcaagccaaggacagcaagactctagctcttgctaattttggggtgtttttttcatccttttctccccacttaaatcttttcttaaaaagtgaggtgaaatccacatgacatgcaattaaacattttaaggagtacagttcagtggcacttagcacatacacaatgttgcatgaaaaccttctctctccagtgttaaaactttttttttttaatcaacccagaaggacatccattaagtaatcactttccatttctctcttctctccatcgcctggcaaccactaatctgctttctctctctctgggtttgtctattctggatatttcatataaaagaagtctacagtatgagaccttttgtgtctggcttctttcacttagtataatgtttttggggttcattcaagttgtagcattgttaatacttcattttttttttttttagatgaaatttcactttgtcacccaggctggagtgcagtggtgagatcttggctcaccgcaacctcccaagtagctgggattacaggcgcccactaccatgcccagttaatttttgtatttttagtagagatggggtttcaccatcttggccagactggtctcgaactcatgacctcaagtaatcatcccacctcagcctcccaaagtgctgggattacaggcgtgagccactgtgcccgggctccatttgtttttatggctgaataatattccattgtatgggtagaccacagttgcctttattcttaactctgtaagctggtggttctcaaaatgtggtccttagaccagcagcatcagcatactctgggtacttgtgggaaatgcaaattctcaagaccatccactccacgaaactctgcgaggcagggcccagacatctgttttataacaagctctccaggtgattctgatgcctgctcaactgtgaggcccacttccataagtagcctcttgattaaggtctcctcatttaaagcatttggggtgaattcatttcctgctgggaccctgatgaataacacctccagctggggtaactgacatctgtttcttgtgtgtttagtgctgggcacactagagcagggcagggggtagttttaacaaccttagttctagaagtagatataaagcacatgttctaaactggctcccagagttccccagtgggcttatgttctggttgtctggagtggaaacttgctttataagacaccatttttttggccgccttccccttcctgtttgatttcaccattctcctactggtgccagttcttcctgtagttactctccatcccccatgcccctaccctcacaaagaaactacttgtgcttgaatctttatctcagggtcagcttccaggggaccccaaccaagataccacataattgaccatcctgaaaaaatggccagtgtgaatacgggtaggagattttttgattcagataacacttgtgctgttacagccctgaactgatcgaggaagattatctttggagtaatgtgggctaactgtgacatttatttctgttaaatcactgtctgctcccagctacttggtgaaggaaagcacatggccctgtttgggattcaccttgaatgtgtgtctaactttgcttgttctgggttgctaccatagtaacaggagtaattaacctgaatttcactctcttgctctctctacaccacctcccctctcccctactccagttcattctggatttgctttgaaacattttagtgaagcagttagaatgccttcatctaccttcatctgcacatcgatgatacccttttcctggttttatcaggctgcttgtttttgttgtctgtacatccatttctttggggatgaagcacatgcatggtatagctcaggcatttaaacagggttcagcaattataaaacacagaagtgacatcaactgggggcagtgtttgggcttcctttgtcaactcagaacatctgtttggctcatgggggcaccttagtttattgctgtcattaagagctgtcagtcagaggaactgagacctgcacttcccgctgaggtgttgaatattaaaaacttacatttcctaccaagggctcagtcctatttcactcttttttttttttttttaaagtaagttcttaatttttgttcataagtgtatactgtgttctaggagacattcaagaagtaaatgactggtcctttttggtggacacttttcacccaaaagaaaaaagaatgataaatttaacaggttcctgtgataatctatgctgcatccctttagcctacctgattttagaagtgccatggtagacagttgcctgtaatttagttgtcccacatcaaagttgtgctgtgatatctctttactgtttcttcaaaacttcaaaagcctgcttagccttgttcagggacaactcagatgtgtatgggatgttagcatcccagatacaacccctgagcaataggttatcagagttggtggacaaatgttctgcctccttgtgctctgatgggacaattctgaggcacattctaatagctcttcggaggatatcagaaggagttgagcaccagttgcccaatgaggctgtcagcctgtcctcttttattcatttatttttctgtggctgacactattgattgcagttcaggtttcatggaaagcagcttccaagatggggatagcacgctggaaatttactgaagaatgcctttgggatcaaccactgtagaagggaagggaaggaagcaggatcagacagcagtagaagttgggctggaatgcagcaaggtgcctctgaaggtgagtctggcaccctttctattctcaccctggatgagctcctcaactctcatattcaacaattgtttatgtaattctgatttctaatccacacttccaactctcatctcttattcaggtgtctgctcctctactcagtagcacctggccatgtgataggttgttggaaatataaatgagtcagacattgtattagtcagggttctctagagaagcagcaccaataggctatataaatagattaaatagacaaagatttatgatggattagctcatatgattatgaaggctgagaagtcccacgatctgccatctgcaactgaaggctcaggaaagctcgtggtataattgtagtccaagcccttaggcctgagaactgggtggctaatggggtaagtcccagtcatgtctaaaggcccaagaaccaggggtactgatgtccaagggcaggagaagatggatggccctgttcaagtaaagagagtgaatttgcccctcctccttgtttttttggtcttatctggaccgtcagtgaattagatgatgcccaaccacattggtgagggagaccttctttactcagtctactgactcaaatgttaatctcttctggaaacacagtcacagacaaacccagaaataatgttttaccagctttctgggcatcccttagctcaatccagttgacagataaaattaaacagcttagacatgatgccagatctggaggaattgagtcttgagggggttgcagaacacagaaaaaagtctttacagtataccctgtcaaattcatggaaatataggaattaaaacaggttggggtgatgggaatattttaagcagcgagccgaaatcacagtgcgtaagttgtggcatacaaatcagagagcagacctgaagtgttataagattgaggctcaaaggagacaaatgttgttacagttttagcatcttgggaccttggaggtcagctggcccacctttacctgaggtctggctcttctccacagaattcttgcaaggtaatcatctaatctcggcttagtttcattgctgtatctagtgattttatgctctctgactggggagtagagatagatgggagcacttccttgtaactttgcccattgactctggttttacctatgcatctctgcttcttcttccatacaacagcccttcatatttgagctggccctttgcatattccccccaaatgaaaaaaaaaccttggattctttagccatttatcaaatggcatcttgcagtcctatcaattcttcctcctaaatatctcttgagtctggtttcttctctttacttccatagtcacttagcatggaaaataggacaaacgaccttgtggaaattagtatcaatggctctatttttaatcttcctcttctctggcctcgatgactacagcagtcttctagctggcctcctcactgccattttgccctttccacttcatttttactgtcagcagagcagtcctccccaaatgaaaatacgaccatgccatattcctgtttaaaaccattcagcaaattctcagtgcccttcatagaaacaatgaaaatctttagcatgcccctgaaggtttgcaatgtctggctctttccagtcacagctccagccttccccttggcaactgacatgctaagcgtttagaaagtattttagcatcttgattatgacatgacttctctggtcccaaggcttcatgtagatggttccctctgcctagaatctgttcctcttatctacctgaataacttctgctcatttttcaggtctgagatttgcagtaacttcatctggtaagcctacactgagtggctacccacctctttaggttagggctctgtgatagaaccaaaccaaccaaccaacctacctccctccctctgtccttccctccctccctccctccgtccttccctcccttcctccctccgtccttccctccctccgtccttccctccctccctccgcccttccctctctccctccgtccttccctccctctgtccttccctccctctgtccttccctccctccgtccttccctccctgcctccctctgtccttccctccctgcctccctccgtccttccctccattcctcccaccctccctctctccctccttccctcccttcctccctccctcccttcctttctctttctttctctttctccttcctttcttccttccttatttttttctttctctttcttcctccctctctccctcctttcttccctcccccgcatacagtaaattaggcccatttttatcatataataactcaaagttatataacatcttcaccatcagaaaggctccctcatatttcctttagtatatacttctcaaaagcaactgctcttctggcagctatcaccatagattcttgctgtcttttaaaccttgtatacctggcatcatacagtattcacgttttgcatctgactccttgcgctcatccatgttggttcatgtggcagtagattattttttccttcctgtgttattccatcttgtgatccattgtatgaatatgtcatatatttgatcattctatgcttgatgaacatttcagttatttccaattgttggctattatgcatattgctgccatgagcacacttgttttttgctgaacacgtgtgtgttagtccattctcacactgctataaagaactacctgagactggataacttataaaggaaagaggtttaattgactcacagttccacaggctgtacaggaggcaggtctgggaggcctcaggaaacgtacaatcatggcaggaagcagaggggaagcaagcatggtctgcacatggcggcagagagacagttaagtgggaagtgctacacacttttaaacaaccagatcttgtgagaactcatttactatcacgagaacagcaagggggaaatccacccacatgatccaatcacctcctaccaggtcccttcctcaacactggggattacaattcaacatgagagttggttggggacacagagccaaaccatatcacatgcatttttttcttaccttgtgatcaatttatttatttatttatttatttattttttgagacggagtctcgctctgttgcccaggctggagtgcagtggctcgatctcggctcactgcaagctccacctcccgggtttatgccattctcctgcctcagcctcctgagtagctgggactacaggtgcccaccaccatgcccgactaattttttgtatttttagtagagacggggtttcaccgtgttagccaggatggtctcgatctcctgacctcgtgatccacccgcttcggcctcccaaagttctgggattacaggcgtgagccactgcacctggcctgattttattttttgaaatacttgctgcctcttccttctgggctcttcctcactggaatgatccttgccaggaggattttactttctactcaattgtcacaagagctggccttgtgacttgctttgtccagtgaaatgtgatagaaggaatgtatgccactttggattagattaagagtcattgcgtggttctgctactgtgatttttccccctgacacgaggttagcatacaggctgacatacagaagaatgaaactggatccatatctgtcaccataggcaaaaatcaattcaaaatggcttaaagaattcaatgtaagacctgaaactataagaagactagaagaaaacccagggaaagctctcttggacatgagtctaggcaaagaatttatgactgagacctcaaaagcacagacaataaaaccaaaaatagacaaatgttactaaagagtggacagcaaaagaaataatcaacagagtgaagagacaacctgttgaatgagagaaaatatttctaaactattcactcaatgggagaaactaatatcccctatatacaagaaacagaagaaaaccaaataatcccattaaaaagcaggtaaagaacatgaatagactttctcaaaagaagacatacaaatggccaagtagaagaaaaaatgtttgacatcactaatcatcaggaaaatgcaaattaaaaccacaatgagatatcatcttactctagccagaatggttattattaaaaagacaaaaaataacagatgttggtgaggatgcagagaaaagggaactgttatgcaatgttggtgggaatgtaaactagtacagccattatgaaaagcacaatggagatttcttgaaaacgtaaacatagaactaccatttgattcagcaatcccagtctcttggatatctacccaaaggaaaagaaatcaatgtatcaaagggatacttgcactcacatatttattgcagcactattcacaatagcaaagacatgaaatcaacctaagtgtttatcaatgaataaatgtataaagaaaatatgctatatacacacaatggaattctatttggccataaaaaagaatgaaattatgtcatttgtagcaacatggatgaaatcagaggtcattatcttaagtgaactaagccagccacgaaaagacaaatattgcatgttctcacttatatatggagcaaaaaatttgattacatggaggtagagagtggaaagatagataacagagactggaaaagtgagttgggagatgggagaggattaagagaactagattaaaaggtacaatcatacagtaagatagaaggaataaattcattatttgatagcagagtagagtgactatacttaaaaaaatatagtattcaggtgatggacactgtaaataccttgacttgatcactataccttacatacatgaaacaaaacttctcatgtactccataaatttgtacaaataaaaaataaacaacagcaagaattaatacaacagactgaaatagaggctggtcctccattctgggtcctaggatgaagaacaggtggaaagagccacagctgactcacagtggacaacagtggagtgagaactaaatatttatggttacaagcaattagaacctgggaatgttttgtaatttccacaaaattttgtctaagttgactgatccatcgcctttccttgtattctcatagcattttataattctcatcataaaatggcacaaattccagtgaagtatcttttaacctgctctccacttgacccccttctaccacaccccaacctgtaagggtggagactgtatatgtcttggtcattcttgtaaacctagcacccagtactttgatgaatgaatagtaggttttcaacacatattcattcaatggaatgacttttaaccttttgttgatgggaaaatcaattttcctaggtgtgcttaccacacatagtggcctggaatggagcaccatttccctttgtctttaacttttaacagttggattatgtgtctcgatgtgaatttttggggatttatcttatttggtgtcccttgtgtagaacaccatttccaagtatgttctccttattgaggagaagatgatagctctaatctcccttcctaaggacaggctactcctaaatatatggcttaggtgacattagtctttgatagtgacatctcactgttggtccatgttgacttcactgtagactcaaactctggaatgtctccttgtggcactactactaagccagttttctcaccctggtttggggcaggttacccctggtgtacttattgatcaccatttccctctgtcgatatgcctactctcacacctttctctggagtctgagtttacttgtttgtttatttcaaccatgccttcctcactgctttctcatttcccatatctggttgttctatctcagcctgtcctccagaaaccccaaaatgctccatttcaaatcttatcacagacctctgtccacttctgattgacatgggcatttatcagcttccagcaaattgaacttcattgtgctacagtataaaggtgtcagagtgagaaatagcctggtaaaaaattagcacttgcaattttgagcagatgccagtataacttttgatttagtgatcatatttcagattctgtattttcttattgattgtagatgttctttacattttctgggtattcattcttggttggctatgtgaattataaacagctttttccactttggtcatttcactttgtttatagtatctttttggtttttttgctacatacagttttaatttgttgacctttatggttgacgattttatgatatgtgtttgttatcttttgtttaagaaattcttcccaaccatgagttaaaaaaagtgtacattttcttctaaaaatatgtatttttaatttttaattgatacataattttacatatttatcgggtgaaatgtgatgtttcaatacatgtgtacattatgtaactagcaaattggggtaattagcatatccatcacctcagacatttataatatttctttgtgatggtaatattcaaaatcctctcttctattttgagatatgcaatacctttttattgactatagtcaccccactatgcaataggataccagaacttatccttcttttctgattgtaactttgtacccattgaccaaactctctccataacccgcgcccctcacccccaccccagtctctgataaccactgttctattcattacttccatgagatcaacttttaaaaatatctggcatatgtaaaaattgtttcacattttggtctgtaatccatcttcatttaaaaaattttatgtggtataaggcaagggtgtaattttaattttactcttttccttacagaaataaaattattcccaaactttgaattgctatatggatatataatgctgttatgtacttcattcatactcatatgttccctattcttttgcaagaaactgtggttttattcttgtatcaagaccatactgcctcacttattatatcttaataatatctttcctatcttttcatgtgaatcccttttgcttgtttttctttttaaaaactgtttttgctgttcttggatttttactcttacatgaaaatattagcacaagttccatgaaaagtcctatttggattttgactagaatcacgtggaccttataaattaaattgtagagaactggcattcttataaatcttccttcttatcatattataatttgccatttattcaggtctccaaaaagtgtttcaaggatgctttgtaattttctctgtaaaatgtcacactttgttttcttagatttattcttagttgttttatgttttttgactaatgcgtatactgtttttaaaattctgtatgtatttcctaattggtgatatttggtgtataaaaataactgctggaatttttataactttgaacttaagcaattgaatgaaaatatgtattctaatcatttttagattctctgggatttcagggtagcagtcatattctagacagataatgataattttgctgtttacttttccaatctttataccatgtattttttttttggtccatttaattgactaggatcttcagaagaacagaaagggtatgtgtatttgtgttttgtttctaattttaatggaaattcttttgaagtttaaccatgaagtcttatttttactgtagctattattatcattattattattttagatatgtttttaggttaaaacctatttctcatttgctaaaattggaggattggctgttacattttattgaatacttttctgcaactatttagataataacatgtctttatattttaatatgcctatgtagtatatcacattttcaaaatttttaaaaatctttttttattattatactttaagttttagggtacatgtgcacaatgtgcaggttagttacatatgtatacatgtgccatgctggtgtgctgtacccattaactcgtcatctagcattaggtatatctcctaatgctatccttcccctctccccccaccccgcaacagtccccagagtgtgatgttccccttcctgtgtccatgtgttctcattgttcaattcccatctatgagtgagaacatacggtgtttggttttttatccttgtgatagtttactgagaatgatgatttccaatttcatccatgtccctacaaaggacatgaactcatcttttttatggctgcatagtattccatggtgtatatgtgccacattttcttaatccagtctatcattgttggacatttgggttggttccaagtctttgctattgtgaatagtgctgcagtaaacatacgtgtgcatatgtctttatagcagcatgatttataatcctttgggtatatacccagtaatgggatggctgggtcaaatggtatttctagttctagatccctggggaatcgccacactgacttccacaatggttgaactagtttacagtcccaccaacagtgtaaaagtgttcctatttctccagatcctctccagcacctgttgtttcctgactttttaatgatcgccattctaactggtgtgagatggtatctcattgtggttttgatttgcatttctctgatggccagtgatgatgagcattttttcatgtgtcttttggcgcataaatgtcttcttttgagaagtgtctgttcatgtcctttgcccactttttgatggggttgtttgtttttttcttgtaaatttgtttgagttcattgtagattctggatattagccatttgtcagatctaaaacaccaaaagcaatggcaacaaaagccaaaattgaccaatgggatctaattaaactaaagagcctctgcacagcaaaaggaactaccatcagagtgaacaggcaacctacaaaattggagaaaattttcgcaacctcctcatctgacaaagggctaaaaatcattttaaattcctggcataaattctacttggctatattttataatttttagaaaaattggattcaatggactttttaatttaggatattcatattaaaatttataaataaaattaatctattttttcttatactatctgtagaagattgtattatcattcacaattatttaattataccttccctgtgaaaggattacatattctcagtgtgacatataatgcctcctggtggctggggtatatacttcatgctcctttgccgagtttgacaataggatttacttgacccaatgtgtgtgtacattgctttgtgtcaatctcacatttttttttttttttttttttgagacggtctcactctgtcacgcaggctaggtaggactaaaggtgcatgccaccatgcctggccaattaaatttttttttaaattttttattttagagaaggggtcttgtttcttccaagtagagggtttagggagcaatatagttattctactaactctctgggtctttttctctttcacaagagcagacatgttccgcataaggaatattccttcagtttgggcccttgaatgtggaaacaaatgggacagggctgagcttggagcacaacctcagctgacctgcagcccacatggaatatgaatgaagaataaatctttgttttttgtaagcccctgagattttgggttgtcactaaagtaaagctgactaatgaattatccatacctggtttaagaatcaaggttaatgcagcctcataaaatcattcttcttccctgaaagcatttatataatgcagaaatagtctgtttccttaatgtttggtaaaatatgattgcacagccctctgaacctagtgcattttttcaggtggagaagaatttcatcaaatgattcagatttaaaaatagttattggcctattcaggtttcctatttttttttccttacatcaattttggtaatttatatttttgtagaaaaattccttctgtatctatgtcttatgtcaacaaaaacctgtttgtgataatttttatgataaaaacaaaatttatctgtattttatcatctaatgagaatattatttgtgccttatttctttttcttaatcaatgttataataagtttgtgtacataattagtactttcagagaacaagcctttttattgtcagaaatttttgtcatttggtcaaaaacattttatcaaaacatctactttttcatatttcattaattgatgctcttttatttttttctagtttttggagttttcttcctagttttaaagatgaatgcatagttcatttattttcggtatttcttaaattagcattgtaaacttggctgcctatagcagagacctgaaatagcttaaatagatgaaagttaatttttttatacttgaaaatttagagggcaggcaatccagagctggtaggataactatactttgcagaagtaaagacccaggatccttctactttcttgtttatggggtattgcttttgtctaccagctgcaagataatttatctctatgcttatgcttcagccagcatgaaggaggaaagggataagaagggcttccctcccttgaagatatgatctggaggttacatgcctcatttctgcttgtatcccattggtaagaacagtcctacagccatataaaagagacttgcaatttagcttttattctgagaagtcacatgtccagctaaaaattaagggttctcttactatgggagcaaggatactggatactggataaggggtatagtgtctgccacagtccactcctttggtatccagacatccatgtatacctatcttctcaaccattccgatgccaaaggagacactctaaaattccttgcagttattaaatccaatttgaaatctagcataccttcataatgtacagttttctccatcaggtctagatgtggctcctcatggtacagtggcttaaaatgtaaaaggtaagttatctgcctatcatatacccaatatacaacgacaaagcaggagcaggaaagcaacaataacaaatcccttttggacagagaagaaagtgaatacacaactgccagtgctaacaataatcaaacaccattgcccatccagtggcctctgattatcctctttggaggaactctttagatcaccatcctttgtgttttctggtggtatgtttttgtctgttctttcttgtgcattatgcttcctggtcgcatgtgagatgggccatgcacagtgggttctccttgtgaatcgaaaagcttttgtagcctgctttttgctggtccatgtcaagtcaattctttgtcaaatattgacaattagctctcttgtttagaaatagattcttgagcctgaagattcttgtgttactctttaaatttgctttgtgccttgttgattgtcctgtctctaacttagtggcagctaactagtgcatctgaaacaaaaacttgtgtgggaaagacacttctattaattgaatcctttcctccaggctggctacaattttctggcaggagcatcttttaaaagaaggtgttgataaagtcatggggccatggtattagcacctgctaagtctggcactacagcgccatcattcttaatagctgcattttgggtatatagaagtaattagccttttcactctgaaaagccccaaacgaccagactcctggtcaacttaggttgtaaaccacaggcagagagtgctttagtgctatattttctttcatctctgttagcacactggctagctttttttttaaacagttttttaaaatatattttttaaattgacaaattgtgtgtgctgaggacatttaaaatctactcagtaattttcaagtatacaatacatggttattgattattatcaccatgttgtacaatagatctgttgaacttattcctcctttctaactgaaactttgtatcctttgatcaacatctccccagtcccagcccctgagcccctggtatcaccattcttctctctgcttctgagtgtgacttttttagattccacatataagtgagattatgtaatacttgtctttctgtgcctagaattatttcacttagcataatatcatctaggttcttgagtttgtatctcttctttgggattttgctaagagccacaaaaaccagtcgtaccaacattctctatatattacatatttagattggtgcaaaggtaattgtggttttcgccattacttttgcttgcaccaagcaccaagagaaatgttgatcaaaggatacttattcttatagcactatagcctctgaacctatgttctatcttccaaggtaaaacattatggttttgccaaatgttttgccactgcataacaaggattatcaactttccaacctgctgtatctgagtcaatactacttatcacacagtgagtattccaatgagacacccgtttgtctttcttacgttcagcactctactttaagacaccaaaattagctgtatatgtgttcaacagcaatagtgggtttcacaagataaatgtttgcttctcatgtgagatactggaggtagacagtccaggcctgctgggaggagtttgtgctctatgaaatcttgaaggatccagggcctttcagtctttttgctccaccattcttaaggtgttccccttgccttatgactctaggagcactgccaactacagtgctcagtgtgttccggtttgcctgggactttcctggttttagcactgaaagtcccatgtctttggagacccttcagtgctgggcaaactgggatggtttgtcactattccgtttccaccccagctggccatagtgcaatataattctgatgctaccacctagagttagcctcagatctcacaagttaaggtctcagtctcgtactagactcctgtcacttcagatgccagccacaattgggggccccaggctatctgcacttctaaccaactggctatcagtctgggagtccccctgccccaggtttgataatttgttagaatgattcacagaattcactgaaagagctaaatttatgattacagttttatcataaagtatacacatagggaaatctagaaggctccccagtgcagcacttccatgccgtctgcctgtggagttagggtgtgtcacctgcccaactcaccagtgggtgctccaatcaggaacctcctcttagctttggtgtctacagttttcactggggtttcattatgtaagcatgattgattaattcattggccactagaagtgattgtattcaaactcaatctccatccctcctttccctctccagaggatgggtggctgaaagttccagccctctaattacatattggattttcctggtgactagcccctattctgaatccatctaggatcccaccataagtcacttcactagggtaatagagacactcctatctcccaggaaattcccagggttttttaagctccatgataggaatcagggacaaagactagaaaaattatttgttataccatagtcagtctgctggcatcatgtctatgttccaatcagcgggacagtgaaaagtgccaataaggcagtttgaagacatgaccagaaagctgcacatgtgacttctgtttcagctccttggccagagcttcaacactggccatgccaactacaagagaggctagaaaatgtggtctttattgtcagcagccacgtacctagctagaaagcagaggttttattattatagaaaagagggagaatagatattgatgtagagttaccagtctaagccatgtttatttggtaattgaaggcagtgctttttctttgatgtcttgcttcagctctatcctacaagattggcatgcagtattttcattgcttctcagttcaaaatacagagtatactgaatgcatattgcttttgcagcatcataaagtctaaaaatcgttaagtcaaactactataaattggggacttgtctgtattttgtaatttctcttgtaatttcctctgtataccatgggtcacttaagagtgctttttaactcaccaaacaatattttccatttaagtaagcattttcttgatttccaatttaattctgttgtcataatataatgtggctatatgatatcaattctttgaaatttattgtctttgtgacccactacattatcagtctttgtaagttttcaatgcatgctaaagaaagaatatagtctgtattggctgatggcagtttatgaaccctcatcactattctggtaaaaagtttatatctctatctttttctttaaaagtagaatcatattgtatatagtatcttgcagatttatttaaacatgtaataatgtattttaaacatatttccatataactacatgtgacttggagcacatctttatttatcaggataaactccagtgggagactgtccttcaatggtatgctttttaaaaagggttcctctaaattattgccatgattatcaattcgtcctcctcccaccaacccctgagaagggttaaaccaattttcgctcccttcagtcctgtagaacgttgcccatttcttatatcctctcaagcattattatgtattatcatattttttatctttgccggtggtcaagctgcttccttttgctgatgagacggaagcttggatatatacagcagcaggcaaaataaagcagagtgagatccaggagtggatcctgcctctcatttcctgcccaggacagagtagggagaagcgataaaatccagctgtgcttttctcttctacattcagaattgtgagttccaaaatttttttttaccctgtccagcaccaacttggctgaaattttgtgaatgatatgtccttctcctaaggggtgaatcaaacctgccaatatctgtgcctcatgcagaacacagagcttgacaatttttttttaagccaaatgtgttttcttagctggaagtaggagaaaaattgagattctctttccctggttgtgtagctcagctgggtcctagtagctctgatctctgccaagatgtttttaggatttcctttcagaaaatggcagttactgggaccacccacctatcctgggatgcaaagagatgtagctacttgaatacagaaaacaaaattacaactgaacttttctaaaatttactatttatttagttttttttttaactgacacataataattgtacatatttatgggatacatagtgatgttttgatacatacagcatgtagtgatcagatcagggtaattagcatattaatctctcaaacatttattatttctttgtgttgggaacattcagtatcctcctcctaagctatttggaagtatggaatatatgattgctaactgtatcatcctacagggctatagaacactagaacttattcctcctatctatctgtaattttttatcctttaacaagtctctcccaccctttctcccatacttcctttctgattccagttgtagcctcacaactactctgtgtgtaaagaatgacaattgctccccttttaaagatgaggacactgagggttaaaaaagctagggaacttttgttggtttgcatagctagaaagaggccttccctgacccccttgaagaggtaacctgcggttccctcagttgctagccacgttgctctattttcttaacatcaccaatcacagtgtgtaattattgccttatttatttgttcgctactatggtagacagcctcctcacttctcagtagtcatgccattttgtagtctcctcccatgttgagtcatgctggtctgtgtgactaatagagtgtatggctgagatggtgatgtttgatttccagtgctaagttataaagggcattgcagctctgctttgcttaaggaagcctgctgccatgtcatggggatgctcaaatatcccatggagaagcccacattagcagtaactgggtctcctactaacagccagcatcagcttgccagccatatgagtgagccaccttggaagtggattcaccagccccatcaagccttcagatcactatagccccaggtggctcgaaacacaatcttatgagagactccaagccagaactgcccagccaagctactcctgagttcctgaccaacttgtgatcccacttgagatatggaattaaaaatgtcagagataacaactgtgtattgttgtttgaaacaagtattgcataattttctatacatcaatagatagttaagatacttgctcatctatttccatggatagactgtaaactctgtgaaggcagggcccctgtctctctcaccactcccacatctagaaaaatgtcaagcacacagcagcaacttaacaaaatatttagtgaataaatgaaacactcaaagtagtagtgagaggattagaatcttgatgctctcatctcaccttctagcattttcccacaatactgtattgcctctcttcccttgcagagtggagccacatagccacctggggggtgggctttttcctgttgcctacagagcaattcatagttaattaaaccattgaataaacagaataagggaggatttaaaagtaatgagctgacagcccagtgtgcattatgctgggctgaaaagagaatttaatttagagaagaattatgcacaggcaaaagagcagtccgttaaaacaaagcaactgtctggaaagagataaaataaaaataggttctgcatcctgtgaaataaatagcaaaaccacacacatttggggcactttggaatcctcagagctgggatctcatgcagagtgggacagggaaacactgggcaatgcaggcaggagggcagaagtggtttcctccagttctcctgtgtgggttgcaggaggtgtcttgctggagcatagttcttgtcataggatttttttgctcacaacccacttggagcttccaaagagcagcctcgagtgtttgatccaaggattcaagggctaatattttattgagaggtgtaaggaacttgagtggataagaagggaggtaatccagggaaagaaaggccaaaaataatgaacccttaatccagctaccacagtggcaattggagcttaatcccctgggggaaaacacggagagacttttaaaacacacatctcagatttatcccagacaaagggtgagagagctgaggtacttatactcccatacccatcaatcattagttgagggctgctgtatgggccaggtaggtgagtgatacggtttggctgtgtccccacccaaatctcatcttgaattttagctcccataattcccatgtgttgtgggaggggcctggcgggaaataattgaatcataatggcagttcctcccatactattctcatggtagtgaataagtctcacgatatctgatggttttataagagatttacacttttgcttggttttcattctctcttgtctgttgccatgtaagacatgccttttgctttcttccatgattgtgaggcctcctcagccacgtggatctgtgagtcagttaaaccacctttttgttataaattacccagtcttgggtatgtctatcagcagcatgaaaattgactaatacagtgagcaaagtggcataccctgtaggcaggcctacgataaagatgcaggtgtgtcctctgttgtgcacgaaatcgtaagggggtctggaggattatgggcagagcattgaaaaattattttccaccatcccaattcctcaagaactctaaaaatttggcccctggacccccagattccaaatacccaagaggtcctctttgacttcttattacacacctctgtcccagtataaaagtcagttcccaagttctggcatttttccatcaactttcacatgctgttcattctcactatcttaattcatttacctagattattcattcactctgccaataatatttgctgccctctcagctaggtgctatatttgattcacaaagtgagcaaacacagatgtggaggtcacagactggcctttagaatccatattaacttgttaacatgttcccataaaaaacaacttgtagtgcaggactaccccaaactcctcaactgtgcaaagcaccccattatggtaagtgctagggggaagagtttgtaacaggctgatctaatctcatcttggggtatccaagaagatttctccaaagaaatgatgtttaacagataaagaaaattatcctgattctgatgaaaaattatgtaattggttgtttaatatctgccacaccttactgaaagctccatgagagtagggatcatgcctgtattaaagaaaaaataaaaatacagagatgttgggaggccaaggcaggtggattgtctgagctcaggagtttgagaccagcttgggcaacatggcaaaaaccgctttctactaaaaaaacaaaacaaaaaaacaaaaaatacaaaaaattagccaggcacggtggtgcacactcgtagtcccagctacttggaaggctgaggcatgagaattgcatgaacctgggaggcggaggtttcagtgagctgagatcgtgccactacactccagcctgcgcgacagagcgagactctgactccaaaaacaaaaacaacaacagaaaaaacaaaaatgaatctgcgaatttaacattttatttgggaatcacagagttgcaattcagggcatatgcacagacaggaggtctttggtatgtctgaggaaaaaaggaaatgttgggggttgtattaaaaaaagaaatgttatgtattctcttgaaaggcaagagaattggcgctagagaaattttgagagctggcaagctctgactagcgagtgatggtggtaggtaaaactagtctcagagtcatagcacgtcatttcagcagatactaggtgaaactggtcttagggttacagcggtcatttcagcagctgggcttgtggaatattccatttcttggagcaggtgctatgtgccccaagtcctttccccacctggcctctctactctgatttagttggctacgacaagaatgacccaattcatgcagtcaactttcacatttcctccttttgatcgagatctttttataaaagcattgcttgtgaatcatcttgaacttaggcttaattgtttctcagtgccaggatgcacttttcctggctgtctctgtcccacactggggggaaggcatgggggctatgtaaggcacccaggtcacatttgagtaataaagaggccagaagaaaaactttttgtcttaaggcaggtttgtctggggtgtcccagggaagcagggaaggggctcaaaggccctgagtgtggattctgcatgccatagcaccaggggccagtgatttccctgaggtgaatcagctttgagtctcacttctgacaccaagtaggtcaaagtcaaaagtacacaaaaaagtctctaaacttaatgttttatttgggaattacagaattgcaatttggggcattcatacagactgagtggtctttagcatatctgaggaacaaaggcaaggttgggggttttattagaaagagaaatgttccatattgttctgaaagaaagctcattggcactagagaagcttttgggagctggcaggcttttatctggtgattgagggtggcaggtaaaactagtcttagaggtatggaaggttgtttcagcagatactaggtactaatggtcttacagttgttacagcaggccatttcaacagctgggcttgtggaaaattcaatttttggagtaggttgtcatatgccctgagtgctttatccccctggcccctcaactttggtttagttgggtatgaccaaaatcacccaatttgtctaatcaactttcacacctgtcttcttcagtgccatatccctggtacctagcacagtgtctggcacacagagagtactcaaatatttgttatacaattgaaatgtttaaagtcctacttggaaaaaaatagttacatactgtattagattaggttaagctgaagtaacaaatataaccaaatatataattgttcaacacaatagaatgtctttttcaactttttattttgaaataaatttaaatttatagataagtttcaagaattgaacaaaagagtcatatactctcaactcagattcttcaattgttatcattttaccatatttgtcttatttttcactctgtcactgtatcatcatctctctctgtctcgctcttagtacagtttttctgaatcatttgaaagtaagttgcagatatcatggccaataactcctaaataattcaatgtgtatttctccaaaacaaagacactcttttgcatagcctcagtaaaaatgtaaaatcaaggatattaacattgatatggtgatactattcaatctgcagactcatttaaatcatgccggttgcctcgataaatgtctctcataagcacccttgtttttctggtccagaatttattcagggtcatgcattgcatttagttgtgatgtccctttagtcctcttcaatctgaggcagttcctcaggttttccatgtctttcatgactttgacatttttgaggagtacagaccagatgctttccggaatgtctttcagtttggctttgtctgatatttcttcatggttaaattctgattatatgtatctgtatatgttaaaaaccatgaactcacactgatgcctccaattccaatctaactcccagcctcccttttttccatatttgtatctctcttctctgacagtaagaaatctggcttccattcttctcaatctagtcacttaatttctcaattcccctgtatataatcaatctcctgattatgcagaccatctcctttgccttgatccctacacactggtcagaatcatgggccatgtcctcctgcatttctttgtgggtcttgctggacaaactcctccccacctacagtcatacaggcatgaggattccaggccttaatctccctgtggccatgcagggtaagggggcagtaacattgactccaggctctgatgctattgctactagatgtttatgttttgctcacataacagtcatgggcagatgaagagttttagggggtggcccccttctcatggtcattcaggcaggattcattctgatagaggctctgttgctttcaacatgtggctttcaggaccactgtgatactttctctcattctgctggaaggagaaaagagcatggaagggataggtggaaagtttctatagaatactctgaaagctgcaggcattccttccacttatattccattggctagaacttaatcacatggtcacacctcactgcaaggaaggctgggaaaagttgtctaactgtgtttagaaagaaacaatgtatttgcagcttcagttttaaaagtagaaggatttcatccatgggctcctagtgtctctttctatgtgtagggatattttctcccactcttagatcccaaattctttctcctattatccttttttcctgtgaagttacaagtatagtttaatattgacaaataaagtgacagtacacttctctccctccttttcctaaactttctcatccatattctttttctgattaggaaccaccaccttagtggggctaagatttcagagtggcctctgtgagttttcactgcaaacttgcaacattttcctatcaatgtctccctcaagaggggaggctctttaatccgatgaattccttgtgttgggagggtgtgcatggaatgttgcctttggaattgccttttaactttattttcctggtttaggaagcatggaaaagatattgacaatctggaattgggagttacaaagttctgagttcaaacagtgcaaagcactgttcactggctgtgtgactctgagtgagttaattcacttttctgactcttattttcttacctttaaaaaatatagttcttcatagggttgcagcaaggattagataacataatattaataaaatgctcagcacagtgcttggcacatgctaagcactcaattaaattgtagcagctgctattcttcttcctctttcagttcatttattctaagaaggttgttggaatgtgccacccacacagcattctaatatgttgttcaaatacatggattaaaagttatgctgaaagccatattctaacctctggcaggcagtaatgacctgtccacagccatgggccatgcaagcatgcactcacctggacatgggcaggggtctgcaccaggccactctcctttctgagcaccgagtgaaggcatcacaggatccagttgcagagcaggagcgcagcctccctgcagggtcagcacctgagcaaagggtctcctaatcaagtcttaggcaattaagagggctcattgtccctctacattgctggctcattagaaggtatatctttcaggacacatgagagggctcgggcagggcaatgtcctcctattggacagaccactactgccagtctggactaggctctgacaagtcccaaggaggttgtcaaaacctcctctgaactgagaactgaggacgggaaccagtgtttcccaacaatcagccatctgagcagatcctgctcctaccttggagctggatcctgtgtctctcctccttgtctgcttcccccgtaacctgggggagagaagagaaggctgagagaggacgtggagaatgagaatgctagtccctgttgccatgtgcattagcacatgctgtgctggaagtctccttgcatccttgggtgtaacccatgagatgttcagagatcatgaggttgattaacagactatattctgtttacctgggctgacctcctcagctttgtgtgtagggggaaagaaaggccactgtatttggtcctggcttaatggtgtggtttgggctgatgactcacctttcctccatgctgggggcttctgtgcagacaaagcgtcagacaaattaaccttgtagcctgacttgaaattgccttggccactgacagttatactgagctgactgcaaagacaggatctgctgctttgtgaacctggctgtgttgccatggataccacaatcccgctatccctctgactctctggggttaggaagtatccattgggagtagaggggccacgccaggctgggggaagggtgggtaaagtggtggataccaggtttcaggaggtgagattaggtgatgaactgggaaaaccccacttcctgaggtaggaactaagtccccattttcagccgggctcagaactgagtccctggaactctttcttttggagagactcccttccccaccggattccagagctggctgggactaggatagtagtggtattcgcctagcagaaatcatcagtttagcttagccaaggaaactttcagcagaatgggatcctggataactgtagccttcaaatgagtcactggtagcagagtagcggaagggcttgtgggctgtgagctgttctgccctgacttgggcaaatctgtactccagttctcttacctgaaaaatggaatgaataatcataatgcaattcctgcttaccttatgaggctgctgtgaaggtgaaaaattaatattggtgtgtgaacacactttataaactttgctaccctctgacatgggtaatctgcacttgagtgccatgatggttggtggtggtggtccctgcccctgctataaatccaggtgcctaatctggagactgaaggctagcttgatgcatccttcagctcctgcttttcctatttctattttcctgtgttatgggccagcacccctaccctctcctaaagtatcagctctgtcagagttggggaccatgcctcatcaatttttgcagcttggttccctccacccctttcctactccgtgcctctctgggatgagtacagaacctgattcctggtgggaacatgcaaatcattacacatgtagcatttaaaaaattatctcaatgtctctggcttttgtctttttgtgtttggggggcatttccagaagcagatcctgagaaaaagattcaagggcaagtagtttatttaggagttgatcctaggagccaccagtagatgagtaggggaagtggggtagggaaaagaagtcgagtcctgatggccatcttctttcctctgcacccagggttggcagaccaagacccatgggcccaatccagcccaccgcctgttctacaaatgaagtcttattggagcatagccagttcacgtatttgtgtgttgcctgtggctgcttttatgctacagcagcagaggtgggggaaggtagcagagatggtatgacccacaaggcctaaaatctttactatctgtttctttatggaaaaagtttgctgacccttgctgtaaacaaaaagctctagacaaatgattcctctattttaaagaggggtcatcagaatccagttagtagcatggtccagcaagttatcaccgtgtacaaagtgagtggggctcatccctgctggggacactgggagcgagtgtagggtatgcctcagtgttaccccacccaaggggtgagggagcagggacatttatctctcagtgcccatctgacccagggctgctgagggggacactgagtgccaggattgggctgtagttcataagcttcagtgaatgtaaggagcacttggaggtagagggagaacatgagaaatgcagatgcaggcctccaaccaggaacggtctcatgtggtgggtcagaggtgggggtggaaatgtgcattgctaagaagccctctttcaccccgatgggcaattctgatggcccctctttaatttaagacagagggatcatttgtctagagctttttgtttacagcaacggtcagcaaactttttctgtaaagaaacagatagtaaagattttaggccttgtgggtcatacagtctctgttgccatcccccagctctgctgctgtagcataaaagcagccacagacaacacgtaaacacatgaattggctgtgctcccgtaagtcttcatttgcagaaacaggcggtaggctggattgggaccatgggtcttggtctgccaaccctggggctagaggaaacaacaggggcatcaggattagattcaggtttacatcctagctctgcctgctgactagtcgtgtgacttttaggtgggtcactgaccttcattttcttcctttggacaatacagataataatttccattctcgagagttgatttgaggagaaatagcatatacattactactgacacattgaggggctcacccatggcagatttctctacaccccgctcctcttcttccaggcatgagagtccatgcctgcatacctgattagcttggtggttaatgcacgaagggagcaggctgaatttataagcttagtttcatgtgacttctcataactgccatgatccagggccactgagaagacctccctggagcaggccatcagctctgggtttaacggcaggcagagaagctacaggtgagaagagctaggtttggagtctgatggtgcctaagctctgagccacacactattctacaagagtcttaactgctcagtttggctctgagctgcctggacaagtgggaaattgtgtcaatgtcgtgattcatagaggccacatagtaaacacaaaccagctgcttaggagagtgatgctcttcctactaataaaaatgagagagatttctcctacaggctctctttgtgaacaggattcttagccctgtcatcagagcaaagacaatattgggttccatggtgctttttcttaagtcccttagtataaggaagtggctaaatgccagagtgcagttcaataaaaacaatactgtgagggccaaaacaatgtgtttcctttattctctgatggtatggcttaattcaaaggcagcacttagagtacctggaggaatggatggtctgacgctttcagacactcctccacaaatattgagctcttggtgaggtctgagtgggagcgagctggaggtcaggtgtctgggtagccgctatgctatgaagcccattaagggtagagctgtgtgctttcgactgtccactgtcctgagggcagcactgatggccattaatgaatgtcggggaacttatcaaggattcatgcctgaatataatgccaccccatctcccaaatgagatgggcctagggcaaatctaggagccagatcagggtctcgtaccacccctatacttttagtctggaagggttttttttttttgttttttgtttaactaactacctttttctatttttttttaatttttgtgggtacatagtaggtatatatatttatggggtacctgagttgttttgatacaggtatgcagtgtgaaataagcacatcgtggagagtggggtattcatcccctcaatcatttatcctttgagttataaacaatccaattacattctttaagttattttaaaatgtacaaaaaataattagaaaagaatgaacgagacctacttttctatagcacaatagggtaactatagtcaataataacttaattagcctgtaagacttttaatggggcttattaaatgttcagttcagttcagtcataaaagattacaaaatattctaatttcaaacagcataatctttcagagatcttttcaagataaatcggttttaaaatatgtaaatgcattggcttgtatcagttagcttttactatgtaacaaactatccaaaactttagcgcctaaaatcagtaaccatttgcttagctcacaatttcacagctatgtagggcccagctgagcgattcttttggtctctgctggacttagtcatgtttctgcagttgactgccagatttgctgggagctgactggtctatgatggcctcagttgagatggtttgtcttgttttacatagtccctcatcctccagcaggctagcccaggcttgttcacatggtgtctgggtaggattctgaataaaggactatgaaggcttcttgaggcctcagcttggaattggcacagttacttgtaccacattcttttattttacctttttaattaacctttttgtttcgagataattatagatttacatgcaattatgggaaataatagatcttcttactgttgattttttttaaaaaagaactctatgttttagagactagtcctcagtcagatgcgtagtttgcaagtattttcttccactctgaagcttgtctttctatcctcttcacatggtctttcatggagtaaaaaacaaaatttctttttaacttttattttaggtttgggggcacatgtgaaggtttgttacatagataaactcatgtcacaggagtttgttgtacagattgtttcatcactcaggtattaagcccagtacccaatagttatattttctgctcctctccctcctctcacccccacgctatcaagtagaccccagtatctgttgttctcttctttgtgttcatgagttctcatcatttagctcccacttataagtgaaaacatgtggtatttggttttctgttcccgttttactttgctaaagataataatgcgggaccatccatggtcctgcaaagcacatgatctcattcttttttatagctgcatagtattctgtcatgtatatgtgccaaactttcttgatccaatctgtcattggtgggcatttatgttgactccatgtctttgctattgtgaatagtgctgcaatgaccatttgcgtgcatgtgtctttatggtagaatgatttatatttcactgggtaaatacccagttaagggattgctgggccaaatggtagttctgcttttagctctttgaggaatcactatactgctttccacaatggttagactaatttacactcccaccaatagtgtgtaagtgttcccttttctctgcaacctcaccagtgcctgttattttttgactttttaataatagccattctgactggtgtgagatggtatctcattgtagttttgatttgcatttctctaatgataagtgatactgagttttttttcatatgctgttggctgcatgtgtaccttcttttgaaaagtgtccatgtcctttgcccgctttttaatggggctgtttttttttctctagtaaatttgtttaagtttctcatagatgctggatattagacctttgtcagatgcatagtttgtgttttttttccatactgtaggttgtctgtttactctattgatagtttctttcactatgcagaagttcttaaatttaattagatcccacttgtcaatttttgttcttgttgcaattgcttttggtgtctttgtcatgaaatctttgttcattcctatatctaggatggtattgcctaggatgtcttccagggattttagagttgtgggttttacatttaagtcttgagttgatttttgtatataatgtaaggaaggagtccagcctcaatcttctgcatatggctagccagttatcccagcaccatttattgaacagggagagaaaaaccctatagtcttggccccaatgctgcttcagctgagaaacaacttcagcaaagtttcaggatacaaaatcagtgcacaaaaatcaatcactagcattcctatacaccaacaacagccaagctgagagccaaatcaggaaggcaatcccattcacagttgccacagaaagagtaaaatgcctagaaatacagctaaccagagggatgaaagatctctacaatgagaattacaaaacactgctcaaagaaggaagacacaaacaaatggaaaaacatccatgctcatagataggaacaatcaatatcattaaaatgaccatactgcccaaagcaatgtacagattcaatgttattcctatcaaaccaccaatgacattcttcacagaactagaagaaactattttaaaattcatatggaaccaaaaagagcccaaatagccaaggcaatcctaagcaaaagaaacaaagctggaggtatcacgttacctgactttgaactacactacagggctacagtaaccaaaacagcatggcactggtacaaacacaggcacatagaccaatggcacataataaagagcacaaaaataaggtcacacacctatgaccatctctgatcttcagcagagttgacagagcaaatgttttcaattctgattaggttcaacttatcaattttgccttttatggattctgcttgtgatatcaagtctaagaactctgtctagctataggtcctgaaaattttcttctatttttctaaagtttatagttttatgctttacatttaagtctgctctccaaacctcagttatcttttcatataagttattttaagttaattttaatgtaagttgtaagaatttgaccaagattaatttatttttttgcctatggatgtctaattgctccataataatttgttgaaagagttatatttattctatgtaattgcttttgtactttgtgaacaataagttgagcatgtttgtgtgagtctgtttctcggttctctgatctatccattgatctgttatttacctctctgtaaatatatcatactgtctcgatgactagaaatataataagtcttgaaattgggtagactgatttatattgctttattcttcttttacaaactggtttagctattatcattcccttgtatgttcatgtatattttagaataatattgcctatatctacaaaaagtcttgctgggattttgatagtaattgcatagaatctgtatgtaaacttgaggagaattgacatctttactatgttgactcttctaattcaacatgatatatctctccatttatttaggttttctcttcatcacaggcttgtaggttttgcagtactaatcttgttcatgttttgctataattttttaaaccatcaatcataatttagaaaactcaaggggaaaagggaagtttattgtaattattcattttgttccttctttgctgatggctcaaggtttcctcttttatcatttcgtttctatttagagaaattcttttagccattcttttggagtaggcatgctggtgaaaaattgtcttagtcttccttcatcgaaagatatcttgatttactattcctttttgatgtatataaatttcagcacttgaaaatcccagtgccatttccttctgtcttccattgtttctaatgagcaatccactgtcattcaaattgattccctatagataaagtataatttctctctcattgcttgcaagatatttctgtctttagttctcacattttcctatgatgtgaattccttcaaatttatcctgttttgagtttgctcagcttcttgaatctgtaggtttatgtattttgccacatttcaaaggaaaaaaaatcagcaattatttctttgattactttttcagtcctgccctctttctcttcttcctaaagtcaaattacatgaatgttagatcttttgttatagtcccacaagcctctgaggctctgttttattgttgttgttgttgttgttgttcaatttttctctctgttgttcagactgggtaatttttatttttataatcttgtagttcactgacccttttttccttctcttttattctgctgttgagtccatatattgagcttaaaatttcagttgtattttttagttctaaaatttccttttggtttgtcttgaggtcttttttcttgcttacactttatattttttcatttgttttaagcatgttcataattgtttgctttttttaaattcagtttgagatattcctggtttttggtacgatgaatgatttaaaaaaattaaaatcaagacaatatgggtattatgagacttgggatcctatttaactctgttttagctggctttctcgggcaacactccactgggggaaggggatgatgctttattaatacaagtttggagtagaagcctaggtttcctgtatagattccattgacacctgggttcgtctcccacattcttttggccagtgcaagttacaaagcctacctagatttgaagactgaaaaaatggatactaccatttttttggtagagcttcaaagtcatgttgaaaaaggacacggacacagggaggaaaataattgtggtcatttgctttagtgattatggatatggctactagttggtaatgttgggagcagctatgaaaagactggtttcgtttgggaatagttgaactaggttatttcttctggcagtgatttgatagcagggccagttttccaatacacattcttttagtatgtgacaacgaaaccatgttatcaatttgtaagggaacatttatcttttattgccctctgtagctggtagacacaagcctgtctcatctaaaggcaaattcacattactgaaatacaagttaaagagaaaggtggctagagcacattctgttttgttcctcactgagaattttagtctcacctgttaggactctttctattaattctccatctcacattggtattagggcctgattctatagaagcatcaatatccaggggttgatacttagctcatgtagcccatgaccaatttccatctatagaggaaagagcaataaaaactgctgaaaatcttatgttgtattaccaaatttttctataagattgtcttaccagactgttatacaaggtgttagagtatataacaatagtcagtagtagaatgaatgggctcaagtgattacatctcctataaaacactggcttgcaaagatgagcgtgatccctgaggctgatccccagctgccctcattgctcattaacataagatactcccaccagtactaggatagtttacaaatgccatggcaacaaaccagaagttaccacccctttcccagaaagttagaaacaacccacccctcaatttgcattgacctgttccttaatttatatgcaatggaatgtggacttatctgagtataaatacagttgccaaggacccatacattgcctattcttggtgtactgcctatgagttaactctgcttggcaaggagcagtactgcttaatgaaagattactgtctaacaccacgggctcacccttgaattctttcctgggtggagccaagaattctcctgggctaagccccaattttggggcttacttgtcctgcatcattccctttgatcgttatgacccaggcatctcaccatggcccatcagaactcccataatcttgtctttcctgttttcctaacatacctctcatatcttccctatacacattagttttcaagaatgttttcttataccttagagtgctcttctgaaggtgtaagtggagtatttttcccccctaagtcttattcaattcctacttagttcacaagtgataccctgataaagccttagtgacccaccatgtggaattaacaaccttttcctttgtgttcgcccaccttgattttccaccattgctcctataacagattgcatacttctccatttccatgcctgttgcccccttttataaagtgaacacctctagggcaaagattgggtcttcacatttccttccttccttccttccttccttccttccttccttcctttcttttttttttagatggagtcttgctctgtcgcccaggcgggagtgcagtggcacgatcttggctcactgcaacctccgcctcccgggttcaagcaattctcctgcttcagccccccgagtagctgggactagaggcgcatgccaccacacccaactatttttgtatttttagtagagacggggtttcaccatgttggccaggctggtcttgaactcctgacctcatgatctacctcccttggcctcccaaagtgctagggttacaggtgtgagccaccgcgcccggcccagggttctcacatttctaacacagtgatggccacatgtttattgactagccaaggatctcttgaccttgatacggtttcctctgaggcaactctggaccctccactacacagagttctgaaactgtagtgccccagcccttcctgggcttcgcaaccagtcttccttctgccctaactctgtgtcccaagaaggggcacatgccttttaactactagcaaagctttgcataccttcttaattaaatttttcagatcagttcctagaagtgaaattactggttcaaagtaattttacagcttttgaaatatattatcaaattaccctccagaaaagtttatttactatttccatttccttgaacatttgctattactcaatattatcattaaaaaaccctctccaatttgctggtaaaagcaatgttctcttacagttttcttactatactcatatgggtattttacaatcttggaccttatttttatgtcctaaatttccattcatggatcttcagacattgatgtaagtgctttcttctctcttcttgactgttcctggactcctcagagttttgtcgggcaggtatgcagcttgggcttcacactagcttcagtctgtgtgtccagctctttttgaatcctccacccaacctgagttgtcatgcagtgttttggggatctcctacccctttgttcatggtgttctgttcatagctactgggaattcctccatgtcctaaaattttcatgcattaagcctgctctgggctgagctctttgtcttgtttggtattagggggagattagaaatggcctccacaggtggtgagcagagcaataactgggaaaacaagcaagatcaatatctaatcctgtgcagtcagccaaccttttcaaagcctcatctgtattgatttctgtgggtgacacttccctttcttgggtaatcagtcccttttctcagcgggtgaacgagtgagcagtacttactcctgcttttgtagaagcaagggtggctgcttaactctgagctgctggagagagggagggaggcccagagtggcttcctttgaaccaaagcccctgtgcggtggcctgggtgatatgggtatttatctagtcacattcttgttctggattgaaggctcttaaatccgaggggacagagagctgtggcttagcagaaacgtggtggagaaaaggtcagtaaattcaatggaagcgaatgagctttactaaacacccattatgacttccagtgagataagcattatcaccttcattttagataaagagtgtggttcaaggaagacaagttacttattcaaaatcacacaattggcagtgtcagaatttgaactcagaagacaccaaagtcactacacaacacgatatcctacacccttgatctgaggacccaaaatctagtgtcacatggtccagaaatacctggatgaatctcttgcggggcatcgagaagaaactggggatgtatacattttggaaaacgggacatgtcaacaaatctgaaggacgatgatatacaatagaagtgagaattttgttgttgctgcttcaaagggcaaaagtaggctgcaaatgtgaaagccacaggaaggcagattatgcttccctagaaggaaacactatgcagctgtgtattgttaacaaaggaatgggttgcactgagatcttccccaacacagaagtacatttctgcataactctgtacttcttagtatgctgtttcttcatcctggagtattgagtgaactcctattcatccttcaggactcagcacaaatgccattcgtccatgcacccatccatccaaaagtattcattgaatgctatatgccaggaaatatattagaaactggggatccatgatgaggaagacaggcatagttactggcttcctgggtttacgttgtggagtgaatctcttctctgtgtctttgacacatgcctactgaagagctctcagttgagcctcctctatggccccacgataccatgcttatgatttaacatggcagccaccatcccatatgtaataatctgtttgagtagaccctgttagtgccctatacgtatccattgggatcttagtatggtcatgtttgttgcctgatttccaattgcccgaggctttctctggcagccagagcccactctgctagcaaagcacagcaggccagaagtaccagacaataaacactctctgggagaagccctcaacaagtgcgttatgggagttggtggatgtattaagcatcctagatctcttaaccctcaggtgggataactgtaaggtgtatgctttaccctgactctgagttccccatatgattaagatctggttgtctgcagtgatcactggttgataatgcaccctatattatcattggctgtctcctttttcctgtttcactttcccactttcctattggagtttccagaaatcatttcctaaacaaagtcgttgcccttgaatcctctcagcatctatttcaagagaaacacaaataaaggcattgttaatgggtaatagtggttagaagggaaaagaatcatagcagaataaacatatttctagtccaagccagtgattgtggcatacacatcacatatgtggtacgagattttgtacagatgatggcatagtttgtatttttgtttagttagcaataaaaaatgtgtgcactgtgtccttttatcttggaacaatcaaggacaatcaagcccacccaaagagatgaagtgaggcagagcagagaaccagcatttgctttgatgtctggctgtcccacaaactctgagcttcaagcagggagcagtcatattttcttcacaactataatccataagcctgcaaaagacattgattcaaaacaggcagcaacaatgcagaattgacttgtaaattcaagtggttctgtttatgagtttcacttttcaccaccgtatttaacgagaacaccaccacaaccaacacaatttataggcaattttctgtgggtcaggcattatggttgatgctctacatacattttctaatttaaaaatcccagcttgtgaggtggttccatggtacaggtgttaatgctgtggcagttgctggtgacgccctgccccatctccccttggcccatctgagttgacctgcagctgtgattctcatcactataacagctcttcacctcaggtgcttccatctctcttctgtgcctcagggttttatctggcattatgggaacttgctgtgtagtacatagagagaatctgaaagtagaagttaaagacctcaggggtagccatcaaccagtgagagaatggagtaggcagatattctgccccagcctccctgtcctgcatgaaggttctgggggcacattttacattatttcttggagtacttcctgtgggactgggctctagtggctcacagcaggaacctgctcatgaacatatgcttgattggctttccctgcttcaccgcttcctcactggctacagaaaatcaccagcatccaagtccttatctcaaggtctcctttgaggaacccaaggtaagacaaccatcattttacaattaagaaaactgatattcagagagtataagtgacttgattgtggttgctcagttaataagtggtggacccaagatttaaacctagatctatcttgtctatgatcattcagttctatgttatatcccgaaataaagacaaaagttttattcaactataaaggtttctatagtcattcacaagcacttactacatatcaggttctctgttaggtgctagaaataaggagtgaataatggcagtgcccaaatgtccaagcattttagagtctaatagaggaagaagtttggaagtataaatagcaaaaaaaaaaaaaaaaaaagctgcagagaagagagcctatcggaaatattccagttcagtagctcaagaacacagtggaaaagtcaatggtataattattaatcacctctacaagagcaataacttggtaattatatttttgtatgttcattaagcatttaaacctaatttttatacacaatggggttataacatggctgtattagtaagttcattttgtattcactttccaaagatgttaacgctcatttaatagtttggtaatttgtctgtgtcatcctaaattattggcacaatcttcattggaggaagaagaagtatttctggaagcccagtgtacctttgatggcttgtggataaaaactgggccgctgtaaactgtcacacacagtctacacttagtccagggaaatatatacaccctcgctttttcatgagatagtatcagaaatctccaaggtatgtctcatcagtccttcacaatggccccttcggtgatcatatagtacctgtcattttcctcctctcctgtgttagctcattgtgatcccatctctgatgatgcccaaagagcattgacatcactgcatcaaaaccctgcatgctgattcctgctgaagtgttgttgatgcctaaacctggggacccatatatagactgtcagtcaataccttcccctaggccgtcaaagcagctgacaacttgtctctccatgccctgtctcttgaagaaatcttggctgtcctgcttttgactggcatgcttccaaggggggattacctgccaggactttctacctgaagagtaaaccccatgtgtcctcatttgcgaagtgggataggatctatcttcaggtctgtagtagacactctttgtgtcccaccgatatctctggctcttaccatttctgtgcatgtttgcctaacttttcattgccagtacatgcatttcttttcctggggtctctctttggctaccacaagcatgacagctcagaaatgccaaggaactaattcctgggagcagccttcagccagtgactaaagggagttattgtataaatatcccagctccttcactcctcaaatgggagaattctgcagttcaagttcaacacagtatctcagagctccccagtggtattgagctctaattgtccatggtggttcctgcttgtgacaccacacctttttactgccttctttcccttctctgtcccacttttccactcccctaccagtgtgtcctgcaatcacctcccaaataaagaacttgccctcagatttttgtcttggatgctatttctgcaggaatccaaactaagacacggggttgccgtaagattaaataccatgtgtgtgtatagctcttaacgcagtgtgtatacattagtcactaatacttgttgaataaataagtggatatatttgactctgtgaagtcttttttttttttttgagatggagtctcactctgttgcctaggctggagtgcagtggcgcgatcttggctcactgcaacctctgcctcctgggttgaagcaattctcctgcctcatcctcccaactagctgggactacagctgcgtgccaccatgcccggccaattttttgtatttttagtagagacggggtttcactgtgttagccaggctggtctcaatctcctgacctcatgatccacccacctcggcctcccaaagtgctgggattacatgcatgagccaccgtgcctggccatctgtgaaatcctacagttttacctgttgttatttctttgtggccccagctctacatttttatgactcctgaattcaacttctgtgcttgtctcaatttattaagaacagtttctagagttaaataagtctgaatctacttgttacttgttttcttctgataatactagattataaaaaattcatgagcttcaaaaggcaatgtcctatgagttacatgagagatccataacaaaaacattcacacatttaaaatagcatgagctccaattaacatatagcacacgcatcccagtaacaacagctgtacatctgctcggaagaaacgaatttggctcatctacctagtctgggctttggctcgtgtttgcataaagactcataggccaaaccctgattgtcttatcctttggaggaccaccaaattgccatgcctttaaatgccttgcaactggacttttacctttaattatatcatagatccagactgatgctccacaggctaactctggatagaagatatgttttgtttggtataaaaaatgtagtacaaattcagcctttaaaaattgagaaatttcaatgaatatatggattcatggttccttttgaaaatattgaagatctagtaaccctgggtctgaatttccacagggcaccataagcagctggtgctaaatattcactgttccttctcaatggggcatttcggcataagctcttttgaactcttacgtctgctacagtcctcaccatttcctattctcacccatctcaattctttcaattacattaactatgtttttattcatttttgttggtgaccatggcttttcagagatgaaaggaaaacagaactctttttattttgttttctcttcccaccgcctttttcttttctttatattttgaggctcaaacacacacacacacacacaaaagaaaaaaccctacttgctgaaacaggtctatagtttcagagaccttaaaaaaggattacattaaattaacactttaggaccccaaaaataaactacactataattatgttcttcacaacttagttataggattaattaattcatggtatattacgtgatagggcttggtaatgggacaaaagattaaagcatgatgaatacttgtcagttggctctgtgaatgaatgtataacaagacaattgaagataatagaaaagtggttttggacacctttggaaatggaggacctgagataaatggtcttcttgacctgtgcaatcataatccttcttttaaacacctggtttatagtcaccaatttaatgtgactattccttatctttattctgggacacttcctactctcctcggactcttggataaatttagtgcaaaaaaaatctctttggacagacttgtggttaacaaagtataaaagaggagggccttttagtatatctgttagatgattacgtgttcttcctctttgggtggaaagattttccctccaagcagctgcatgctgaataatgcacaaaggtttggtctagtcaggaatgttaaacacttgtttatctgtctctttattcaccacatccaggggggatcaagacaagaacaaacacactgctttaggaaattaaatccactcagattggtgtaaaattccttaacatcaggtggtctcaataaagctatgttctttcaatttatccatactcttttcaaactcagcatgatcccaaaatatacaatattgatggtctttaaacatagtaattcccagcaaatcccactgtgttctgagtaaaactgatcagatcctgcacatggattaggtatgccatgtctgtctttcttaattttatattctatggcgatttggctcccaaatcatgagcacactgtcagatttagtgaccaaatttctcatcaatgacaggcttgatgacactcaaatatgtcattcatttcttcctcattccaaaatacaccaacattatatatcatcattcacccaatttgacttataggctatttttaaaaaatcattctcattctgtccagacaaggttgataattcaactggaacttacatccacaggaatttaataattatcaaatttggaggaaaaattaattcccagcttggtcttttcctattttaatgctggccagtttttctgaaatttttctgtgattgttttttaaagataggatagattttagatccaatttaactttcagtttatcagcatactgttcaaagaaaatgaatgtaatttttaagttcaaattcctagtacactagagtgtggatttaaacattagacaaacgcagcactaataaaaacaacaattttcccttggctataatgccagctcttcagctttgggaagggatcacagtcacccttctttgccttatgcctgggctagctttcccaataacaagtaaatagaaccaggctctgcagctatgcacatatcttccagaaaatgtcatttcttcatcttatttctccagaatccctctgaaccaaactcctgaatcttctctttgctttatagggagcttttcagttccttcatactctatgggaaaccagcaagcaatacatgaaaagtatacaaaggaaaaaaatcaaatttatttctatcaccaccccctcccactcccacttttctccctagaggagaccagggtcaacaattttatatgttaatttctgatcagaggacgaacttcccccatcttttcttaccatgttctatttagatactgctaattcttaacaagttgaaaaatgatgtagatataaaagccaaaagaccaattatttgatgtgagagtaaccaggtcactgtcaacctgttttgagatagcatagacctgacttaaacgtagtgtgtgtgttgttttatcttgagggattcatatgttcccttcctccctcaattccatttgctccttttaggactcgcaatcttcatgctttgctacattcctcttaacttcataaatatgctaaaactcagagccaatcagagcttttctatgtgattgatagatggatgcttttggactctgggcataaataaggttgaaattgcaagcggtcatctttcccaccatgaagaaagagcctgtctgagaaagaagacaaagaccttgtaatctggtgccagaacctctgctggactttccaagttgcatgagccaatacatcccctttatttaatgtaagccagtttgagctggttttctgtcacttgcaattgaaatagtcctgatgcatatgcagaatatgtcatggttcttgtaaacatctaattgtaaaattttttcaaacatgtgtatgagactgaagcatctacatagactgaagcttcatgaagacaatctgtcttcatgtgtactgattctggataacatagaggaaactgctgaaaaagataatacacctgcatatgcaatccatggtactgcgacagcacataacagaacataacctgatgtggagatgttctggaaagatgtcctagagatgggaaaaaatgggaagctttccagggtgagctataagaaagtggggttccaggtgagagctaggttcacttcagtgcagaagaggaaagagagtttgagggtatagacacattcttcatggttcagagggttctgggtattgaattggaagggtttgggtgagacaagaacaatatggaattagggaagcagagagagaagcatagagcagtgtgggaatatacatatgggagaggaaagctaagaaggactcactaatacaatcagaaatgtgagatatggggagtattaatgaaccatggggtttcccaaatattttagcttggggtgaagggactggtggttggctcagtctataggcattaagtgtaactctgtggccttgggacagtcaagtgctcatgtccaaagatgtaccctttgattttttgtccatccatccatccatccatccatccatccctccatccctgaatccctacatccctccatccattcctctatgcatccatccatccatccatccatcttctcaaccattcatcctctcattaatctgtttaaccattatccatccctgaacatttattgagctcctgtcatgtgccagggcttatgttgcttgtcaaggagaaggaagaaaaaacaaggtttttatcttttggatacttcagtctgtgatgtaaaaaagatacgtaaacacatcattgcaataccttttgctaagagcaacaacagaaaggattttacaaagtgccgagagaaggcatgttggttgtgaagattaaatgagattaaatgtgtgaaaagcactttgtgagctattcaaatattagtcattataatcttcataacagctctggtagactggcttggattattatccacttaaaatttttttctgctataaaaatacctaaaagttccactacaagttacaaaatagagaaaataagaactcatccacatttatggtgcttcaacactgacattgttttacatgttgctaagtgtcattagtgtctttattcctggaattttattttttttcatacaacaatcatgctgtgatatggtctggctgtgtcgccacccaaatctcatcttgaattgtagttaccataatccccatgtgtcgtgggaggggaccccttgggagaaaattgaatttggaggtggttacccccatgcttctgtcctcatgctagtgagttctcacgaaatctgatggttttataaggggctttcccccgttttgctgggcacttctccttcctgacatgtgaagaagtatgtgtttgcttcttttcctgccatgattgtaagtttcctgaggcctccccagtcatgctgaactgtgagtcaattaaacctctttcctttataaattacccaggcttgggtatgttattagcagcaagagaatgggctaatacatgctgcatatatcatgattcggattgttttctctttaaattaaattgactacgttttcccatgtgtaaacctgtttcatgggtcacatctatgcaggaggagtgggagaggtcgccatggtaagagttgacatgtctctgtctcagcctcagcctaaaccccaccttcctggttcctcatgagttactgggacccttcataacaatggccacatagattccctgtccctgtcatggtcttctctgccactctagacatggagctgtgcctggtattgtgccatattactttctcctttatttttttgctgactctgtaaagcctctgtatgtctgctgatgagaagctacctttctgtcctgagctctgtccccatggcgaagggagaatgtacttttgtatccatctgaatcgcattggtggatcactttgtgcctacgttagatgtctaaggttgggggagatccatacttacctctacttcctttttaaaaaaaattctctcttaatgataatccaattagactctcattctcatcactgtgccagtacagctcatgttaaggtgaccaataaccttcatgtttccaagtccaatggctagtgctagtgctagttattatcttacttgacttaatagcaacatttgaacaattgtttacttattcctccttgaagtgtttttatttttttcacttaacttccaagataccatactcctgatagctcctcctcagccccttttgctagtttctcctcatttccttgacttctaaaggttggaatatcctaggactcaggcctgcagacatattccctatctacatttgctacttaggtgatcccactcagtctcatggctttaaataccactataggctgatgactcccaattttatcaatccaacttatagcttttctctgacctccagatccatactttcaacagaccattcatcatttccatatggatgtctaacaggcatcttaaacattacttgtccagccaactgatggttttctccccttgcttgttcttcccatgatcttccctattttagtaagtgacatgtctgtttttccaattgctttggctaaaaacattggttggagtcatcttgactgtctttcctttatgccctgtattcaaatcaccaacaaatcctgttctctctccttcagaatacatcctgaatctaaagctaaccacttttcactacttttcccactatcatcccagtttaagctaccagcgcctttcactgggttactgaagttgcctcttaactgctctcctgatttggcctttgttcccctgcagtctgttctcaacatggcagtcagagtgattttatttttaaattttacaactcacatcacatcatgccactcctctgccccccaaaccttccattggctcccatctcatgcacagtaaaagccaaaaccttgctatgaccacaaaagccaatacagtctgggccactggcctcatctcctattattttcccttttgctcatttttttttttttttttttagaaccactagcttccttgtgtattggttgttcctccaatacactggcacactcctatcttggggcatttgctgtttccttctgcctggaatgctctttcccagggcacatggcttattcctttcttccttcagatctctgtccaaatgccactcccttaaataatttgtctctgtttacctgtataccatagcaactctgtcccatgcctaacatgctctgttccttctgtttgtcttttattagacaaatcacaagctgaccatatccacatctacacacatgtatatttatgtttgtttactacccacctctcatcctagactcaaaatcccgtgccatgagatcaacggctttgtctctgtgcccatggcacttacagcgatagctggcatattagtacatgtttcataaatacatgtgtttcctgttgccaactcttatgatctcctcctatgactaggaatgtgttctttgtagcccttgactcctttcctttaatgatgtaaagtaataaaatggccaacttactcactgagcctcagtttcctaatccacatgatggatctgataatagctctcaccttatagggttgtaagacagaaataaggtattgcagctgacatcctcagcacgttgcctggttcacaaaatagattttaatgataattctgaacactatggagtcagatgaatcaggatttaaatgacttatatgcaaagcacaaatcaggatttaaatgacttatatgaaaatcacaaagtaaatgctatctaagtatgaggtctaataataattacatttgattcattttcaagagtttttgcagtccaagaaaaatgacaacttcccttagtctcaattccttatctctactatagagatgaagtagctgttgtgacaattagtaagatacagcatgtaacatgcccaaacactgaggatgtttgttaactgtttccctactgtgggacaatcagattatttcatctggaaagccattgtagacaatgctgtgatgcacatctttgtgcataatggttttcatatatttcagattatttccttaccttggaatatcaggataagtattattgagtagaaacttctagatatttttatggtctttgttacataagccagatggatttcttatcctcattttgcagagtgactctgagccttcaggttacttggctactaagtgtcagaattaagatcagagggctgggcgtggtggctcatgcctgtaatcccaacactttgggagccctaggtgggtggatcacctgaggtcaggagttcgagaccggcctggccaacatggtgaaaccctgtctctactaaaaatacaaaattcagccgggcgtggtggtgtgtgcctgtaatcccagctacccaggaggctgaggcaggagaatcgctggaatccaggaggcagaggctgtagtgagccaagattgtgccattgcactctagcctgggcgacagagcaagactctgtctcgagaaaaaaaaaaaaagatcagagcgcactcaggggctcacgcctgtaagcccagcactttgggaggctgaggcaggtggatcacatgaggtcaggagttcgagactaacctggccaatatattaatatattaatcaaatatattaatataatttctcttgtttctttcacttttcaaaatggaaaaccaaatatcatatgttctcaaagtggcagctaagctatgaggatgcaaaggtttaagaataatataatggactttggggacttggggggaagggagggagggggatgaaggataaaaggctacacatggggaaagtgtacactgctggggtgacgggtgcaccaaaatctcagaaatcatgactaaagaggttattcatgtaacaaaaaaccacctgtaccccaaaactattaaaaaatgtggacactagaaaattaaaagttacatatattgcttgcataatagggatagtgctgttctagatgctataattattaacagatgctataattattaacatttattgaccatttatgtgctagtcacaatgctaaatgtttgccatgaattattttattttcacctcaaaacaactgttttgcaaatgaggaaaccaaaaattaagtaacttgcccattcaattataagcagagcaggtgaaataaaacttgtatctgacaagcccagaggcagactgggcacttggagccaaattatctgagaaaaagtgcaagagagtggacatacttaagccaaactcatgggagacatgagaactctttacaaatacttcaaagaggccggcgttacagatcacgcctgtaatcccagcactttgggaggccgaggtgggtggatcacaaggtcaggagttcgagaccagcctggtcaatatagtgaaaccctgtctctactaaaaatacaaaaattggccaggcgtggtggcaggcacctgtagtcccagctacttgggaggctgaggcaggagaatctcttgaacctgggaagcggaggttgcaatgagccgagattgcgccactacactccagcctgggtgacagagtgagactccgtctcaaaaaaaaaaaaaaaaaaaaaaaaaaaaaaaaaaaaaacttcaaagactgtcatgtgggtggagaaataaacattccaagtggctcccaggggaggagcttgatgattctcagatggttgtttcctgccaatgtttttcttctgagctccagggtcataaatccaaataccttctcgactcacccagttgcatctctcttaggtatttctttttttaaaaattaatttttttaaagttctggggtacacaggatgtgcaggtttattacataggtaaaagtgtgccatggtggtttgctgcacctaacaacccatcacctaggtatgagatcatgtcctttgtagggacatggatgaagctggaagccattattctcttaggtatttcaggctgaacatggccaaagcttgttttggtttctttccttaaaagcttgttccaccattagggttctaagctcagtaaatgacattgacatgcatgtgagttcccatgataagaacatgggcaccatcagggacttctttctcttctttgccctggacatctgcaaactcctcaagagttgaaaaagcatacctttcttgtttctctgtttatattggttatctaaggctgtgtaacgaatgcccttcaaaattcgcagcttaaaacaatgaactttacaagctcagtttctgtgggagaggatccaggaacagctgagctgggtcctccagtctgggtctctcagaaggatttgatctgatgcttcaatcaaagcatcagctggcgctgcggtcatctgaagacttgcccggagcaaaatccactcccaagtgtgcttgtgtggttattggtaggattcatttccttgttgggcattggctggaggctcctctcggctgtttgccacatgcgcctctccatagggcagctcatatcatggccccagccttctgtcagggtgagggagagaaggctaggaaaacggaaagaggcttttgtaacctaatctccaaaatgatatcgtatcatttttgctacatttattagaaacaactcactaagtccaatctacattcaaatggaaggattacattaatatccaatgcacgaatgccaggtactgagggtcattggcagcatcttgaagctgtcagccacatatcccaaccatgactgtgatcagcatactgttggtcattgtattccattgttaccgctgtaatatcttggctatttctttctctgcagccttactacctcttttgtggttcattgtcatctttcacctggacagttgcaaaagcctcttggctggccttcctgccttctgtcttccttcttccatccatgtcccgtttctggctttgtggctgaggcaggaatgggtgatggtggtgtgtggtgagcaaggagtctagttccagactggtccattagagcatgggtgggtccatttgcagagttattacagtccaggtcaggtatgagccccagaggcatgttctgggtggtgaggaagaggacaggtaggagtgacgagagtctgagctttcacgaggagcctaagaaccctggctacaggagcaggggcttggaatagaggcccaaagcagaaggcagagctctgaatgtggcttcttattggtggttccatcttcagaatgccattctgtgactgtgccttggaaccggaattgggcaccagttgtcaccatgggccctgttgcaccaggcaggctgccgctggccgctgagtgaccacttggtccactgcagcctcatgcgccattcagcaatatcattccttccatgccttccacctgtagagacagaaggggcgagccaggagcagggctctcccaaggcctccttagtggctgtgagaaattcgctgatcttgttggacgtgtcttgccagagtcttctttccctttgaaactaaacttgctctatttttagaaagcacagaatagcagagagaacacagggtctggggcaggcaactctaagattggagtctgtctctactactgattacctgtgtatccttgggaagttatttaccttctttgagcctcagctttttggtctgtaaaatggggatagcaaagcttaccccatgagataaatatgagaaaacattcacaggtgcatacagcacagtgcttgttcaatagcgggaaatcaaatcaaatggtttgggaagagaagtatgcagagcacataggggctgcctcagaggtgggttcttcaaccacacaggtgttgtggataggatccagggcttcagggatgagaagcggggatttggcagagaaagctgtggctgatgtttctgggaggcagattttgattccacacaatgaaaaattttctgcctttcagagctttcctgaacaaagttgctttcctatggaggaggtgagtttcttgtccttagaggtgttcaagcaaagccagaatggccacttggtggggatgttgcagaggggataaaatatcagggcgatgcttgcaagagaagattgctaaggtcctttctaatccctgggaattaacatttaagagaaatctgaatgtaacagatatgacataaatacatgacagcactttcttagctgcaagtcagtgtgaggaaaggggtggtcattggatttccaaaggctggggtttgaaggcactgctgatttaggaaggaggtggagccacagctcacatttgaagggacctcctgcagctacagaaattactctttggaatagacaaaggacatattgcaggcaacctgtggtttgtagcatagctggggaaatcagcatcccaggaatggttgttacccaccacttggacaggaaatgtcacagacaaagccttgttttctgctgcaggaattaaagttcagaggcagctgcaagaaaatcaataccaagctgctaaacccttaatgaacgacagcaaaaggctgatggtgttgcctaaaacagcttttttaaagctgcttgtctggggtgagagtgttaacaataattgattgagctcctatgaggtgtggtttccagggtgcagctgcgcaatgtagggaaatgcatgttggatccaggagcagtcaccacgggctcatgtcttgcttggaagcttagtcatcgggttactgagtcagtcattagtgttagcaacttgggagtccagttgttaggcctatatgcatgcagccactcctctccacaccccactgggtcgggtcctctggcaaaagatcaatagccagatcagaatcaaagttcctgttttagccatgattgaacaagtgctccaggtcccaattcattgccctctgggagaagcagagctcgagaaacttgttctggctgctaggcttaactaggcttcctgtttcctactcacttttgcttaaatcggaggtttttttgttctgttttgtttttttcaaacaaacctataactcgacagagaaaatgaacaacctggcagaagggagggcaagggtatatggcacaccacccatcggtgaagtggagctcagtaaatgccaccccctgaatgaccccattagccattcctcctctccagggggctgaaagtgtgggtagaaatttctttcttcaggacctaggcagaaacttaaagcgttaagagaaaagatgtttcccactgggccatttaacttgtcttatttcccatttccccatctatcaagtgggcacaaaatatcctccctgttttctgtacagggttgttgtaagaaacaaatcaaattacatccatacgagtttgtggtaagccaaattgcttcctccaatcaaatgggatgtagtgcttttgtttgcgacctggaggaggaatcccaaggacagaagaaaaaacagggaactgttgttttgattaaccccccttgaatcctcacagcatccctgtaggcagatattaacattcttactttattttatttttgagacggagtctccctctgtcacccaggctggagtgcagtggcatgatcacagctcactgcagcctcgacctcttgggctcaagcaatcctgccacctcagcctgttgagtggctaggactacaggtgtgtgccaccatgcctagccaatttttttgttatttttcgtagagatgtggtttcaccatgttgcccaggttggtcttgaactcctgggctcaagcgatctgcctatctcagccttccaaagtgttgggattataggcatgagctacggtgcccagccaacactcttgtctacaaatgaggaaactgaagtagggtaatcaaccatccgggcttgcccagaactaaggggttttctaggacatgggacttgcagtgctaaatcctggaaagttctcagcaaaccaagataagctggtcaccccaaactcaagtccagaaactttgagtgactgtcttaaaccccaaggctgttgaatatcattgttggattggaatgcaggatagttaccctagtactcatgttctttcctgcacccctttctgctaacactctcattgggccgacaaaatatgcacatatgaatgagttgcaggccaagaagatgtgctaatcaatgtcatggggtttcacaggaaacagaaagctttgctacgaaggggtgctttgctgtgataccttagatctcaatcttcagtggttctcttttaagggtttgcttaagaagatacctaagttgggtatggtcatagataaagtcctgctttataagccaagtggcacattgactaacatctttattgtgatttttaaaatcttgtttggtggctcttaaactttagtaccagggccgggttattaaagaggcacatttgtggggctgccatcagctatcctgattcagtgtgtcctaggaggggcccagtaactgcatctgggtgacctggttaagtcatcccttccctctgctcttcctggaactattgcaacacccacgtaactggcctccttctctgtaaagaatccatcagtgactttccatcagctccagaagcaacccaagctctttagcctggctgacaaggttctccaggggctggccccagggtcccttacagccttctcacctgccagacttggcctgctctctggactcccgcagccttgatgtgcagataacctggctcactgtgccgctgctgcttcccggggtccctcttcattgtatggctcctcctcctccccatctttaggcattgactttctcccactctttctccaagatgccgttcaggcatcctcaacttcaggaagatgcccctggctttttcccacatgcactgccctcatggaggggaaatgcacctgatggcaataacttacacatacactgagaatgaccctgtgtggcagacacacctgaatatgtgttccaagttagagaatctgggagtggccaacctggagatttgttcgttgtctctgaggaacatctgagccccacctgtcctgtggaacactggcagtacaagggatcgaggcctcagtttggggttgaataaaggttgacaggtgtaagttgttagggaaagggtgctaagtgaaaatgctatataaactccatgccttttgcaagtggctccagtttttcttcccagcccaccaccactgggctgtgtggttctcttgtccagcccccaacctctgtactttctcccctttatgtaagcccccaataaaactctatgtctcattcgctggctctgggtctcttctttggcctcttgaacatggtgccatcccactggagtcaacaggggtttggcaaaacacccacccactttaggtggccttcggtatcatttgaataacccatcagggtctgcctttcccactgaaccgtgagtttccagagggcagaaactggttctcaattcctaacataaggaccctaaaggtgcttattgaaacagatcagaccagggtggaggcaggaggcattgtttacctggcattggctctgtgagctcccataagccatctgtggtactgattacccactctgagcacaccagatcaagacacaaggcactcagcaatactgcaaacattagtttcaattgctggggtgagaagggattagggaatagcaaactgacaacctggcttattctgagggctaaattaggaacaagattggcatgctaatgggaaaaatagtgagcctgagaggtggtgtatattagagggaatttggggatgtgacatggagctgctaaaagttaaagtcaggcgacttaaggtttagagattaacggctgctcttgacagagaggccacttggtagaatcacactctctttgtcagtccttatctcagtatttaactgtaataaattggtaaactccctaatggcaggaacttgcctattgccattgtattagtgcctggcacgtagtaacagcacaataaatttttgttgaatgaatgaccactctaaatactgctttctgcctccaccttccacagggaggtccgatctaccctaatcttttaagccaatttgcctttctctgtcctatatccttgctgcgctaggaaagcaagccccactttcaggccattctgacttctctatctttgttccagaactgcttgggctctggcctcttctctggggtaaggacctgggtcctgcctctggccccagatcctgggcttctttgtgttatttggcatctagacctggccttgcccatgtttatgggcttggtctgcatctgccaccgatatctcaggtccagttctggcattgatgttgtggaaactgccatctctactggcttcttggtgggcccctggccaggtcagccccagcccttgtgagaagaggacaatgacttcttgcaattgctgatcccagtcccagcccctgcatacctttcatctcaggctgccttccaccactgtctttaagatgttagagtgggctggctcaaacccttggcatcccggggtgggcccagtatggccctcctctttgagagttgaaaatcttcacatttatttaagaaaagtcctaggtttggttagaaaaataacaaacagaaatgaggtttctagaggcctaccaaagaaacctctgattgggctggatcagaacaggccactctggaggaattatagtcccagtgaatgttgtgtgtgtgagtgtgcatatgtgtggtgtacatggtgtggaaagctgtgtggggtgcatacatggggtatgtatgctgtgtatatgtgtgtggcatgtatacatgttatgtatatacatgtggtatgtgtgcatggtatatgtggtatgtatacatgtgggttggtatgcacaggccatgtacacatatgtatacacacgtgggtgtatgtgtggggtgtgtacatggtgtctacccctatgtatatgtgtgtggcatatgtgtgtgtgtgtgtgcccatggtgcatatgtgtgtggtgtctatcaatgtttgtatgtgtgggtatgtgttatgcagagtgtgtatatgcatgtgttgtatgtagtttgtgtatacacatgtgtggtatatgtatatgtggcatgtatacacatgtgtggtatgaatgtatggggtatacatggtccatatacatatgtgctgtgtgtgcacgtggtcctgaggtcctggccagggtgggggcacgtgcaactcagagatgtttgagcaggacatggcttgaagtgtatgtgggagccaaggtctctggtgggggaggtaggcagagcctcggaatctcggagatggagacaaagttgtggtcagccaggggagcaggaggccagttgatatgaaatgacccagagcgaggccatgggcaagggggtgctggcatctccgttctcggagctgtgtgggctgggtccgctggcttcaagggcagctctggcagggagctgggcagtgcacgcctctgctgaccattgtccacaggcatttattagcatgaggcagtgccaggccctgcatgaggtgctgaagagaactgacagatgaggttcctgttcacagaaaacaaatatgaggactgagaagctggggacggtggatggggaagagggatggggagaggaaaggagggaaggagaggcagagattcctggggctgggatggaacacaaagggtagaggctgtccagctgcttggactgaggacggggaggatcacactggaattacagacctgtgttcaatttgttccaattctccccgtcaaaacagaggtcatttctttgagtgattattaaaatactccagtgaatctggagccccctactgggtttgttggtttccccaagctaccgaatctggttccccactcactatcatctggacatccagtcggcccacaaatcccagactgctggggaagccgtattaggttatttgggagataggagcctccttttcctttcctccccccacatttcagttcctgatttttttttttttttttttttgccgtgttagcaaatttgatggatggtggcaaatgcttgaggataaaatactgtaatcaggaaagtgtcccctccctccctccctcctcctctgtccctggatctggtgctgaccgtttttgtggagtcagcagatggatggatggcttttgctgatgctttgctggagtgataggatgtgtggcaggaataaccctgcaggctcctgagaaaaagaaaaacaggaatagctcagggaagtgggggaactgagagggagaaaggggaggggagaaaatcggagtgaactggagatccctgctgtggccctgcccacagtgtctgatggtccagaccctattacccaaacccctaagttgagcaatggcaacagactcttacctggtgccttcagctccaggctcaaccccctcaatcctttcatctggcactgtgccataatgatctaaggaacaaatcccccatagtcctccctcactcactctcacaccttccatggctccctgcttcccatcaaatcctgtgcaaacaccacagtctagcatcaaaggctctctttgacatcactgcatctattagcaccccattttggatacccttgctattgtccagttttgcaaaaagttattcttaaacatggctttctggcctttgtgtgactatactcttatttctttccccatatggtcttttcctcctattctcccatcttagcctttggaaatcccatctgacctttaactctgactgcaaatgtcatatttgccatgctgactttgtaagtccccttgtcaggtaacattctgtcacctgctacagcgcttatttctcaaaaccttttgttagtattactcatgttcatgtctgtctttgccattagattgtgaacttgtgaggactgagccagatttctctctccgtggtggtctgtcctatctcatgtttaacaggtacactgtgtttagttgaaatttgttgaattcaagtacagaattgcaaaatattctacttgataaggcaaaattaatgttacagcagtttggtgcagagtgtacatttgctgaaaactgttgtcttgtggaaggaaggataagaatctgttttctagaggacttttgagcttgtcttctgaaagcctttctgtcacagtttggtagcgtatcagtcagctttttctatgctacaacctcaaactctcactggcttataacagacatttattttcttgcttgcaggtgagttgatcaagctaatcttggctccaggtcatggcttgggttcaggtctgagtcttatagttccttcttctccttggattagtaactccctggagtgtgctcttcttataatggattccaggagtgtcagaggccaaaccaaaccctaaaagcatatttgtagcctcagtttgtgttatctccacaatcctattggccacagcaaatcagatggccaagcccaacatcaatgggctgaggaaatatatactgctgaggtagtggtaggagctgcaaagtcatatggcaaaaggcttgggcgtgaaattctaataagggagggggtaaagaattggagatagcaatccaatgtacctccagtgatctcagggttggggaagaaaacccctacagaatgggtacaagaacaaagaacttaaggataaagagcagacataggagcagtagtacatagtttaaaatgcgaaggtcgatatttatgtctatgaccagattggaacttgctaaccatctgttcatgatgaaaacccttaaactctctgaacttcattttctcctgccacaaaatggagacaaaagtacaattactatacttattgggaggggagcttgtgaacaagcaggtgaaaatgctttgctagctgaaagagcccaagtaggggaagaagctaatgggagcaactgtccccagtggtcagggaaggtggagaagatgagagaggttcacggcagaacaatgcaggaacctcggtccatctcaagtccacctgcttggggcatcaaattttctgccccagccaggcaagggcttagccctaagttatgtgttctcacacacacctctgagctctgccccatcaaagtgcccatccccatctcagattctgggtttcacccaaacctatgtgaacagtgtggatagggcctctaagagtggctgtaaggatccagcactaaaagcaacagcatggtgctaggcacatggcacaggcccaatactgaaacaaaacaatacatttaccaaatgaatgtggattaatgcacacatctgtttcagacgttttctcactcagtacaattgacagaaacgccatccattcatctcttgcaggcatccaccaggatgtggaaattgcttagattaacttgttaaatccatcaaaatggtgtttattaaaatgggattttatgtgttgaccacataaatattcataactttatgacaatgcccaaacacataccactgcttctgcgtcctcgccactctgccaggagaaaacatcacgtgacaacaaaacggagcccgtgttatttacctgacagtgtgttctgataccttggagcagggctctgccaagcaggggtttttctgacagacagtatgcagctgctattcccttccccactgtcctctgcagagctagctcatggcccattttccctgctgttcctaagcacaccaagtacttgctttatccatcaaactcaagtcctttctttcaggagaaagaaatcgatagaaattgatttgaaaatgtcaaaccttatcaactgctaactgtcactccaagccagatattttaaggatggtgtagacatttgaactcaccaaggcccttctcctggctctgaaagtctatggtgccaccagtcaacctctaaatagtctctgggggcctattagagagggaggtggcatagcgcagtggctaagtgtgtaggcttaggagccagactgcttgtgtttaaattctggccccattatttaatggctgtgtggctttgggaaggttatttaacttctctgtgactcagaagtctcattttgcaccttaggataataataagatatacttcatagggcagtgagaactaaatgacaacctgtgtaagccacttataaaatatggagaatgttataagtgcaccattaatagtaatcactatttattacttatatgccactttgctaggcatcgagggttataaataaggccagttgggagaggcaaggcatacacaaggcaaatggggcacctgatacgtagagactgaagtctgaagtcctgggtttgaatatcagttctaccacttacttctccatgattttgagcagtttccctggaactgtttcacctgtaaaatggcaggtgaaaatcacagtgattgacaagccagcttgttgtatgtttctagttagaaaaccactttgagactagaaaagcacagtgtatttgttagcaattttataccagcgaaaggtcattctgtaacatggagtggcaaatgctaaatgccaaatgtgtaggacacagaaaggttcagcatcaagagagacactttgggcagagattgtcataaagggcttacgaggaaaggtgggattgaactgggctttcagaggaggcaggctttggaaagtccagaaaatactgcctggcatatacgaggcccaacttttagcaaacagagatataagcttaggagaggtcttgatttagcaaagaggaattctgaagtgacttctttttacacttggggaagcatctggattattacaatcaggtgtgttacctgatctgggtgttagtaacttcctggattttgcaaggagcctagctcagggtgggcaaaagttgaagaggaacacaaggtaggagttgatggagttggccaggtgagaaatgatggtggcttgggctaggagattatagcagtggcaatggagaaacccagacagaggcaagatcttttttggaggtagagctgtcaggactcactgatgtattcattcagtttattaattcagctgttctaggctctggggatatagcagtaaacaaaacaaacaaaaatatgcttatataggttaagtactggtgggaggtagaatgcaggggaagaaaggggagtaaaaaggatgattcccaggtttcctgcctgaggggatggagtgatatttgcttcataatgcgattttgatgccctttgttacaagttgctaaggggcatcatcttgccttgatttatccagttccttctcttctttgtgaagctctggatcttcttctttgttctttgttccatcatctgcatcctactgccagggactaatgggagtcaattctcagtgtctattaatatgccgaaaggttaccttttatataatctcttcacatacctgtacagttccatctatgatgtagatacacatggtgctgggtttaagtttcttttcccttgttatactctgcaaggtgctattcacaaccaattaacccctttgctctcttgcagggatgggaggactcatatcctgccctgcattgagtagcatgtggtagctccctggttgaatctgactttaaaatgatcccacttggacaggtgatccagctttcattgcacttgctgcatgccatgatccaaacccttctttctacattttactacataactttctatattttactacatacgtctttttgaccagccagtgttggacgaattgaactaagaagagacagaattctagaggaaatgtacaactggaacaaagatacagaggcaggaaattccaggcagagtttggggcccgcctgatgatgacaatccatttgaagactatgcttgggatgtcctgtggaagacaactagtgcttttttgagtgtctaataccagctggtgagccactttcatctccctgctgagagaatacgtggaagaagcctctcacttagaattataaaggatcctagtgaacataatttcagcaattaccaatgttcagtaattatgctaatgctgattcacaaagggctgttatttgctcagcatgttctgtgcacattatctctttacctgactaacagtgttttctcactgcagttatggtttgcttgtcatgttaagtgatgtttgcatctttgagcttgtcaagacactaggattagagccaaagtcttgttcccacccccgttacgaagattttcttgtgggcctcttgatgagaatggaaggaaaggggaaaaagcaaaaaagaagcagaaaaaggaaccctattgacttgtggggaaattatagttcagaggcgaagtgagttacagagaaacagagagctaggatttgtatcactatctttctgattcctgatagggcctctggtgattaggaaggttgagagcttgcctggtctcctctatctgtaacacaacaacagtgcgtttttttggcttgaaatggtcataccattctgagtttctgcttcaagttgtaagagtgcttagagattatctaggacagtgatgctcaaagcgtggtctttagaccagtggcatcagcaccacctgggaatttgttagaaacgcaaattcccgggttctatgctagaactagattcagaagctctcagagtttttgtgttttaacacggtcacatatgtattttttccttgagatggagtcttgctctgttgcccaggctcactgcaacctctgtctcccgggttcaagtgattctcctgcctcaacctcccaagtagctgggactacaggcatgtgccaccatgcctcactaatttttgtatttttaaaaataggcactgggtttcaccatgttggccaggctggtctcaaactcctgacttcaactgatccacctgcctcggcctcccaaagtgctgggattacaggcgtgagccaccgcacccagttggtcatatgtgttttaacaagccctccaggtgattctgatgcatgttcaagtttgagaaggatacgctaggcctttgatactggaattgtgggccatagaccagcagcatcaatgtcgtgggagagcttgttaccaaagcaacatctcaggccacacccagacttactgaattggagtctgcatcttagaagatctgcaggtgatttatatgcatgctgaagtctgagtatcactcattctactccaaatgcttccacttactgttgacaagaggcaaaatgactggtagatgttgcactaagtagtgacagaaccagactgctattactcctactaaatagctaacatttattgtgtgctttgtgagccttggagctgcttttgtttaaagagggcttactatgtgccagcattggcccctggacttttaaaaaattactttctttagagacaggtttcactctgtcattcagggtggagtgcagtggcatgatcatagctcactgcatcctcaaacttctgggctcaagtgatccttccgcctcagcctcccaagtagctgggattataggcttgtgccaccatgcctggctggcttttcccgtttaattctcaccatatccctttgaggtaggtataaaaatctgcttatctggaatgggtatttggctagataactgaaaaaaatcaattaaggcaagaaatcatacaaattatatacactttaagcatttaattttaacttaagcatataagtgtacatgcattcatgagtcttttgatgtggggggtccaggtattttccttgagtacccaggtttcctttctgctgaagtttacatatcaacgatgatccctaacttaacttgctttgaagtgggcaagaattcaacctgtgaagaaatctgagggcaggaatccttctagaattttgttttccccaaactccgaattctgtagaattttttaaaaagttatttgcctgtgcacagtattcaaacacagttttcatagatgcatagattcttatatataatatttaattaaatctgtgattatagtaacaagtataaatagcgttagcacgcttggaaccaatgcaagattaaacaactcagcttttagaagctgcagcgaatgggtgtgtcagagagtagcttattagccctgaacattctagtgccatgggtttggtcaacgtgtcttagagaattggcaatggtggttgaataccaaacagctgagctcttaacacatgttattatcactctatgaggttcagaaaggttaaggactcttctcaaagccacatagctagaaagagctggagctgggaggtagacccagccagcctgcatccagagtctctactgaactcccctgattgtctgtttaggtaaaaaatgataatcagtctttttatcttgacaaagtataaacacttctcctttttatataactataaatacttctccaaatacacgcttcttcctgccctcactgtccttctatccttaatttagaaagaaaacttggtgttcttgacagatgagcaattgaaatggatgcattaattgatttaaatgtccaagcatcaatattctctgacaaaacattgtcagtgcacagaagaccagttaatgaagaaaataaccatggaagggggaatcaattagactgaaagtttagttgaaccctttgataaagcatctgtaggtagctaggtagcatgcatttctccttccctctgttatgtccccatcctctcccatacacacctcttattgtgtaaagcattatacatccagtgaaatactacaccttatggtcctagttctgttattattcctgtgcaccatctcctttgatgtgactcattgctggttacttgccttccatgccctatatgtaaaatgggggtaagaatagtacttgcctatcagagctgtagagagatgtaaatgggaaatgcttaggacaatatcagatacattgtaaatgcccagaaaatggtagctattattgtttttccaaccctttttccctagggaaaagataaaaaagacttaatcagacatagctaagggaaagcattctgttttagctcttttggccttcttttgtaatcctagtccagtgcccacaaggctcaataaatatttgtagaaagttgaatagatgaatcgtaggtcagtgtttttccccaatctgcttctgcatctcatgatggtctatgttatacgggttgtttctctgtatcaaagccttttatacttctgtagtttcaaagaattctcagtctctccatctgcaattgcttacggtcttcatattgtcaagtacggactttttctgaactatgttttcaagggaatcttgttttcctctcatattctcagaaaaatgccaacagacaattgcctgcagaatgacaaatggctcacatggcttgttgctccgctttgttgcttggatctgagtgccctgtgatctgaggtttatgtctcttggctgcctccatgtctcactgtggttttatatcccctggctttttggcagaaacaaaacttttagatttgtcctcaactgaaaatgtttcagctgtgtgtgcaggcgtcttcatgctatagaagaaggaatggaactgtgaatggtgggaaaggctgaaggaagtaatggagaccacgatgcagaagtaggtgctcttgcaaagcagtcccgggacagataaaggaagcaaaggcagagaaccccaacgccttgtaagtaagttcttttgtcttggcggagttctaacctggagttgtctgggataggactgggatgctagaagccaggttaggtgaatatccccgtgggcaagtgaggatcacctgcagctctttttgtcttaggtggttgtgtcaagtgcctttcaagtgcctcttcaccacccagagctattctttgctgtctctctgctgtgctctgctctcttcccaggaggctgactctgatcgattgcatgagcaggttcctgtgccctttagcttcagctaggtgggtccagtcaacagggacccttggcaggagatcagaggtttggagggaggagggtatgctcagggtatctattcctctgaaggaattgcctcaggctggctgtgcctttcagtggcaggtaaatgttcccctcaaggtggctccttttatgaaattctctccttccagttctggtatctgttctctctcctcgtcattttgagcctagaaaagataacgaccacattgttactaatcccggggtactgcactgtccctgaaagcttccctataacctgcccccacctttgcaaatggttcttttattaagtcctgttcatgtgatcccagtatgagtttgtctatgcttcatgcaaggaccctggctgttacagtctcaagttgctctgcctctgtaggaaaacagtggtatctgagaggtaagagtcaaaaagataaaaatagcatggctggatatgaaagaggtggtttcagttgcaagcaataggaaacagtcccagctcacttaagtggaaaaggaattcattggtgggatattgggtatggctcatagaattgggaaggctgaggaccaggcaggaagctgggcagcagggaccacagggacattctggttaggatgatgctgctggttactgctgctgtgaatgcattctcaattgtaaatgcatctttgcttcacttccttagggttcagcatcccaggtaggagcatctgcttggccaatgctgggtcacatacaggatcctagttgcaggaaggggagaagttaaagcttctctcttccatctgcgttggcttctttccttcctcccctccccatcccaccaatagttacttctggtttctccagggctgggattgagaagagaggagacgtatggtcaggaaaggttgtacttggcgggtactgtcatgagctggtgttactagtctctgggattggcagctgttcaaagctgagtcttaactctccttgaccgaatctatcttccttctgtctggccatctggtattctatctcttctgttgggaatcccatcccagctgtttcctcccagtcattcttgggagaaatccaagatgaccctggtatggcacccctccaagggctgctcaaaacctatatttttccttagcctttggagaaggccagaaagcatttaattttatcaatctcatacagtctggctgcttgtattggaggcagtcggctggtgtaaaggttcagggtggctttagagcccactctaataaacattgagaagctttgctctctgcactcatctacacagaagctggtttgattttataaagaccaccccagaactatctatccaagctcccagacatgagccaaggtggagatagcccagaaggagacatagatggttctcttggaacagggtttctcccagaaaggattttcagacaatatagagtttctatcaatttctaccctttcctagaaaaagaataaagccttctaatgatatttaacacttctaaatttccacttagccaagaacaatggtgcccagtctgtcacaattgaccgtgttttatttgattgttatgtgagctttcattatgtttcaaaggcctcatttgccattttaaataagcatttattgttattgtatatcaacctatgaactcagggctcttagttaatcttgtctttttattttttttataagacatctgagtaaatgtaaataagggtaacttcagcagtttaggggtctcgataggtcaaactagaaccacagagactgggacttggctctagcctgatattaataagaaggtcctatcccacatgatttccgctttccctgccccactacccctgagctatgaaaggtcaagacacaggcttttgagaaaggatggaggccaaggaggactttactaggtaattactattatctcaaagaaatagaaaaggtaccaattgtcatttctttatgatactaaattttaggagagatttctaagatgttcaaggatgatgaatatataaaatactggttttattatacaaatggatcttgggataatattagtgttggaagcttttggggtctctgcctaataggaaggatttttctttttttaatttagccatttggggggtacggatgatgcagatataagaagtcaaagacattctttgcatttgaagcaaaagcatctcaaatcgctattatcttcaccattaccatcgccacccataatatcttcataaatctttatgcacattctttattactttctttagataaattcttccaggtaaaatgactagctaaaagcatatgaattttaaaacttatttttaatgaaaaattttatatattttataaaagtagaaaaaatagtgtacaaagattttaaaatcttgtaacatgcattgcttagctgccttctggaaagtaccattaagttgcaccctcataagtcttgagaattcccatatcctgacattgtgcacaggactggactttaagtgtttttgctcaattcactgaatgagaaatggcatcacattgttgttttaattttcattggtttgtttagtagtaagggtaaacatttttccatatatttttggtcatttgtttcatgatttctttatttatatactctgttcaatttgccactgcctattcctttcttactaatttgcaagaggtctttaaaatttaagaatattaaccctttttctggtaagcacattgcagttatttcaattattttctcatttgtcttttgccttccaattttcttcattatgtttcttgacatattgaaatattatatataataatatgttatatatatattatatatatatatattttgagacagagtttcactcttgtcacccaagctggagtgcagtggtgtgatctcagctcactgcaacctccgcctcccgggttcaagtgattctcctgcctcagcctcccgagtagctgggattacaggcacatgccaccacgccaggctaattttttttttatttttaggagagatggggtttcaccatattggctgggctggtcatgaactcctggcctcaagtgatctgcctgcctcggcctctcaaagtgctgggattacaggtgtgagccactttggccaaaatattacatttttatatagcaaaatcaatctagtttttactggtggttttccttactttggttacttgcttaggactcaaacatatacatttctctctctctctctctctgtgtgtgtgtgtgtgtgtatatatatatatatatatatatatacacacacaaacaaacacacatatgtgtatatatacacacacatatacacatatagatgtttttaatttacacatatagatgtgtatatctgtgtgtatatatacgtgtgtatatgtgtgtgtatatataacatacatatatatgtgtttatatacataacatataacacacacacgtgtgtgtgtgtgtgtgttgtcccttgatatatgcaggggattggtgtctgaccttccaggataccaaaatatgcaaaagtcagccctttgtattgataaaagagaaactttagttgaattaaatttaaaggagtttaattgagcaatgaatgatttgtgaatcggcagaccccagaatcacagcagattcacagagactccagcgcagccacatggtggaagaaaatttataaaccaaaaaaggaaatgacgtacagacatcggcagagaggtacagaaacagctggattggttccaggttggcgtttgcctcatttgaacacagtttgaacacttagtcctctgagtgtttgaagcacggctgctgggatttgccaagactcagttatcgttacaggcgcatgctcctaagttaggttctcaatcttgtctgactattaagctaggctacagttcatccacaaggactcaaatagagaagcacagagtccttctcagaccatattcagtttgcttcaacagtatacctgggtttctcatccctgaaatactgtattttcaatccacatttggttgaaaagcattcacgtataagttgacctgtgcagttcaaacttgtgttattcaaaggccaactgaaaaaaactacatatttaacactttagtagtttcatttcctgtatttaaaaatctttaatacgtctgggatttttttgggtatgtgaatagtacaagatagtattcttgggatttttccttttcaagtagttaaataatttgaacaatccttattaatgtagtcttttcctattgatttaaagtgctgccattattacatactaaatatttatgtctaaggctttttattgtgttcattgatctgtctaatcttgtacagtacccaagtggttttataattgaaactgtatataaggttttactttttgacgatttaccctgtctctaattcttccagccaatatttcctctttttctaaatttttggcttctctcagatgtttattccctaaacttcagagttgttcttacaattttatcaactgctttaaatttataattgatttggcataatttatatttttatatatttaagtcttgccctcaggagcattttgtcactttctcttctatggagggaaggggccatattctatggcctcggtaaggtttggatgtgttcttcataaaatgtttacttgttgataattaaatttattcttggagattttatattgttgttacagctatgaatagaatttcctccacttttttttttttttttttttttttttttacagattatggcatgtatataggaaggtactcatttttaatatgtattttgtaaccgccaaatttaatgaactgttttattagttctaatactttagagttgatacttgtgttttctaagtagaaactggcatcatttacaataactatgattctgaatatttttcaacattctttttttttcatttttctctctcttcctctctcccttttcttcctctctccttttctttctctttttccttatatttccagcacttctaggatgatgttaaggtaacaatgagcatcctaactcggaatagaaatatctcttgctttttaatttaaattacatatgataatatttcattagttattttgcaactcccagtagttgtgtatgttctatgggagtctgctcccttggctgtagctgattgagtcttttcaaggattttttgatttggaagtaaggggactaaagaagcccccttttgattgtgggagccataggactagaagtcaggaattacagctcagctagatccttgccatgtgaaggacagaatgaatctaatacagaaaactgcacccagtggagagagtgcagatggcatgagtgtctggctgcagctgcccttgacacgcagctctggggaggggatctcattcctatagttatttgagttgccccattatccttctaataaattcccaaggtaagtttaaatttggtttttggtacttctaatcctgagaatataggtcctctctcttttaaaaaatatttcttacacaattaatggtttgctggagtcgtccaatttctcaactcttctttaggaatatataaattacccaaatttactttactgaggatttcaaattgattagcagagaattatccctaattctttcttatgagtaaaaataaactcactacttaatgtgaaaaagctcatatatgttacctagtttctttctacggtattttctagtataaaacaattatactgttagaagcactgcatttgaaagattatattatgaaaaaattgtttcaatatgacaaaagaaggttaggagttagacactttcagatctacaataaattattttttctacagaaatatcaataataaaggtttatttatttttatttctgcaggtatattttgtcattgcaaatgaaaaatgaaaaaattgatttatcaataccaacagaaacaaactcaaatatctccttacttgtccttatattctcacatgcaggaacctcctattctccttgagtcaactttgaacttaaccttacacttttgcttgcagcacaatttataaaagtcaacagtaaaaaagaaccatagaatgtgaggataaatgaaagtacacattcctatgataatactcgagcactcacagcaggctgctgggtcttcttattctcattcagtagcttgtctaattttgaaccattggtggtccccataatgtatatcagttaacttttactgcataacaaaccacttcagaatgtagttccttaaaaaattcaacatgattttgtggtttggtgactggggctgggttcagctgggagattcttctggttttggctgggcagtcagctgccaggccagctcagggctggttgaacaaggagtgggctcaactcagtggcttatctctacttcacatggtctctgattttctagaaggctagcctggctttgctcacattatgatggcagggttctaagagagagggagaggaagtaaggtttcttgagacctaggcttggaactgtacaaggtcatctctgccatattctattggccacaattaagccaaaatagactcactctcttcatgacaggacttaaaaagtcacattgcaaagtgcatggctacagtgaggggtgagattttaatatctgccatataatatgaattgtgttactgtagttcacaatgcaaactgtatccccagttaatcaacaggttactttctgttgatggtgaaaaacttaccagaaggatgtgtatatgtgtatgtgttgtgtgtttttcagttttctgaatcattactttttgtttgtatttttgttaatttatatgtgtcaaacatagagtaggcatttaatagatacatgctgaataaattattgcatggtttgtctaatattttatagctaagatttgagttttaagtttagcaaatattttatattcctttttgtttaatagtaaaacatggaattaagtaaatttgtccctgagtagagatttagtcacataccataggaaatttttttaaaatttatttttatttttaatttttgtcttcatagtttgatgactgatcacaaagaggcactttagtatttactacccaggtgcagaagcagatcattgctagccttccaagaaatggcctttatgcctctattcggttgctgctcctctctcccctcaaagtaactactgtcttaatttttatgttaattacttccttgcttttccttttgattttgccagctacatatatgtacctaaacactacagtttagttttgtttgctttttgaactttatagaaatggattaatatagtttatttttgtctttctggcttatttggtttcacattatctttgtgagacttatgacatagttcactcattttaattgctgtttattttattatatgaatatactgcaatttattttttatacttttacacacatataccaccatttatttgttcatttgagtactaatgggttgttttgttaattggtctcttcagctttgggattaatgagttgataatgaataaatggtgaaatggggttgaatggcttgttttcagttttttatgattataaataatgctgttacaagcattcttttatgtttcttgatgcatgtgagcatgcattactaggggtgaagttactgggtaagaggctttgtgtgtgtttaacttcagtggtgtagtacaaactgtttcaaagtagctgtatccatgtgcactttcaccaacattgtaggagagcttccactgcatccatccttgccaacactttggcatggtcagactttttatttctagccatgctggtggctgtgtagtggcatcttgttgtttggatttgtatatctttgatgactaataagataaatcatctttttttttttttttttttttttgagatggagtctcgctttgtcacccaggctgggatgcagtggcgcaatctcggctcactgcaacttccacctcccgggttcaagcaattctccttcctcagcctcccgagtagctgggactacaggcatgtgtcatcacgcccaactaatttttgtatttttatagagacggggtttcactatgttggccaggcaggtttcaaactcctgacctcatgatccgccccccttggcctcccaaagtgctgggattacaggtgtgagccactgcactgggtgaagatcaatcatctttttacatactttttttgactggggggagattaggattttctcttttggaaagtacctagttaagtctcctgctcattcttctattgagttgactgtcttttttcttattaatttatataacttcttctcttgactttcctttttgtaatcttaatggtattttttgatgagtacaattcttaattataatcaagtccaacttatcacactttttttcttatttggttagtaatttctatgtatgatttaagaaaactttctctaccttgaggctctctgttgcattctacttttcagtttcattagtttttgctcttaactttctcatttgcttccttttttttttcgggctcaatttgctattccttttctaaatttttaagactaaatgctttgtttactgattttcagcttgtattttctttctaatataagcatgactttagttatgtctctcaaattttaatatgttttattttcattataaatcacataaaaatattttctcatttccttaatcatttgttctttgactgatgggttgtttgaagtgtatttcagtttaaaaaattcccaaacaaatggcaattatttttgctattatttgttcctgatttcaaacttaattctactgtagccagagaccttactttgcatgatgtaaatcctttgaaatttgctgactcttgcttttgtgcaggatatggtcaatttttgtaattaatgttccatgtgtccttgtatttaagtctttgtctcatgctcttctgagagaacacaggctaagatatgacagttgaatcttcattatgaaacctagactttatcaatatgtaacaatctttcttgtcctgtgtaatatgtttttgctttgaaggtactttatctgatatgaatgttgtacttatgcttttaaaatttgcatttatctaatacacatttgcccttttcatatttaacatagaaagatacttcacttgtgtccttgaaaactgtatcgttggattttgtccttgacttaattttggaatttttttcttttaatagtggaattttacatattggcatttactgttaaaactatttgatattatttccttagctttgtttcatgttttaaacttttatgcctcattgtttttctttgcattgttttaaactagagaactatatttacttcaaaaaatgccattttggaagatatattttaatcagagtagtgggtttatttaagattttcaaaaacattctgtaactgttgctttttaaatttttataactaaacatgaaattaatttttcagttttttctccttaatatgcagtgtgagcatatttttattctcttatcctcaacctcttgggttttatgaacacaatctagtgtcttgcattaggtaatcttttcttaagaataatttttgacatgtgcattgttttataaacagatttacaagcattacttagacgtatcacctttttggctgattgcagaactcaccattgtcttttaataccttgatttccccaaagttgagttgttaactatatcatgtcttgactatttagtgttcaagtggttttttaatttccagaaggatgcatggtggcacattttcaaagtctttgttgaaaatggttttgtttttgcttctacactaaaaaaggcgagttttccgggtctaaaattcttaagtggcaaacttttccagactgtgtctagatattaatctcttcattgatgcttgaaatcagatatctgaaatgtagatatccttataatcttattacagatcatttctctagtctgggaaaacattctcttctttttcttcttattgcttctgttctgttctggtatctcttgaaaatgaataagttatctttatgttgcattttgccattttctgtcctccatttctattatcttctttatcataatgtttgtcattgtctttttctccttaattctgggaaagctagtatttttaaaaatcagtatcactgaatgttttattcagtataatgttttattcttttttcttccattatttaaaaatttgttactgcgttttactttttcacttttcagacttttaacgcttttttgcccaactgtaccgagaaaaagctatactgcctaaaatgagccaggattgaggtatctctgaaagtcttttcggagactcatttactttctccccagatggatcactctctgtttggagagagaatttcaaactctgtgctttctgtatggtcctatctcctcagtatctatgaggactcttgaagtttctggcatgtatttatttagcaaatacttattgaatacctattattttccaggtattcttctaggtacttgtgatccatcagtgaatgaacagatagataaatacccctgtttttttaaaaaaaattatttgcgatagcggtaaaatatatgtaacataaaatttaccatattaaccactcttaagcacacagttcaatagtgttaagcacattcacactggtaggcatccaatctccaaaattcttttcatctttcaaaactgaaactctgtacccattaaacaacaacttaagtattttctcttcttcccagcccctggaaacgaccactttactttttacctctatggattagactactctgggtacctcatatgcatgaaatcatacagaatttgtccttttgtgtctggcttcactgagcataatgttttcaaggttcatccatgttttaggatgtgtcagaatttccttcctttttaaggctaacattctattgtatgtatatgccacattttgtttattcatttatcaataaacacataagttgcttctatcttccagcgattgtgaataatgttgctatgaacatgggtgtacaaatatctcttagagaccctgcttttatttcttttgggtacatacccagaagtaaaattgctagatcatatggtagttctatttttaattttttgaggaaccaccctgttgttttccacagtagttgtaccattttacacttctactaacaacacataggggttccaatttgttcgcatactcaccaacatttgttgttttccatttttttaacagcagccatcctaattacccctactcttatggaactcagattctaacaggagttagaagaggagagagatgacaaaaaacaaacgtaatatgccatacgttatgtagtattttataagctgatataaacatagagcaggaaaggggaggatcaggaatggtggtgggagggggtgagattggtgctaatttaaacaggtgatcaggatagctccaccagtccactgacaagatgatgagcaaagacttgaaggaggtaaggaagctgacctcaaatggaaaaccttctggtgtctagccttgttggggctgtttcttctgagtttggattttactgttcatttggacaggtctctgcgggtggggaagttaggtggggtattgtttacgtgtgcttgagaaactcccatgcctgagagccctcatctcttcttggcaaaccttcatagctggctctgtaatggggccattgtcatgctgggcccagacacagggtgaggaggtgaactagggtgaaaagtggcttagagtcaggtggctggcaagctctggaggctgctgatcaaggtcaacctgagctgggataaagagaacagggctgattgggagcatgtacaggacacaggtcaggaacaggcagtaaataaacatgaggggcacatgcaaagcctgagcataggacaggtttcaaagttccaggctaagtctgaggcccaatttgggaaatggggagagactatgggcagcttgggggatatctgtgactcatagactcattagactatgagatggggtttgagggctggtgagagatctttgtatgaccggaagatccaggtgagagactgggtgaccaagacagtcaaaaacagggtggaatttggattctgagacgtttgcccccagcagggggtgaaggtggatatatgggatatgggtggccagctggctgtagtggaaagtgaggcagcagaggggacacccgcagcagttcgctccttgacacaaaaacttctcagcccttcctcaactgtaacttttgtggaaactctcattgcctctcccggtgtgcttcctcctgcacctttctcttgagaacaggctctgcctcttaactacagtggtccagcctgagtattccatccccagccgccatgatgacttcatggtagaaatggccacagttggagaaatcagagtctttgtccaggaattttttcttttttcttttctttttttttgtaaatgaattgatactggttatttatttgtttgtggtttagtcagttaaattttgcattctttgcaatacaaactcttcaggtatcagttcctcaccatctacctcccatatacctctcatccttccacaagcttttacctatataaaggccaaatatctcctcacaatattaacaaaactttatatatatatatatatattttttttttaaattatactttaagttctagggtaccatcattctcagcaaactatcgcaaggacaaaaaaccaaacaccgcatgttctcactcataggtgggaactgaacaatgagaacacttggacacaggaaggggaacatcacacacaagggcctgttgtggggtcaggggaggggggagggaaagcattaggagatatacctaatatagatgacgagttaatgggtgcagcacaccaacatggtacatgtatacatatgtaacaaacctgcacgttgtgcacatgtgctctccaggaattttttctaatttgagctagcagggaggtcactcttgtctgtttcatggagctagaagggtgtgaatctatgattgctggtgactaaattctctgcttcttggagagagtctgtctgcagggagaggggaagagggaaaaggagaggcagagggagaaggggagggagtggggaagggggaggggagggggagagggaagggagggggagaagagggggaggtaagttggttttcagttactgaggtctcctatctgcctgtattcctaaaactctgctttgcatccttgagctacctcaggatccttctccctagattctcccttcctcccctcccttttctcccttccctccctccctccttccttccttccttccttcctccctccctccctctttctttacttcttttgtctctttctctttctttctctctctttccttccttctttctctctctctctttcactcccttccttcctctctttttctttcttttttcttcttttcttttctccttccttccttcccttccttctttctttctttttctttttctctctctctttctttttctttctttctctctctctttctttttctttctttctctctcccttccttcctttctttctttctttctttctttctttctttctttctttctttccttctttccttccttccttccttccttccttccttccttccttccttcctttctttcttgctttctttctttctttctctctctctttctttttctttctctctctcttccttccttccttccttccttctcatgctagtttgagttgaggtttctctcactcacatacaaaagtgttctgactactgtaacaagatttccaaatagtggcagcccttcttttcttgaatctctctcttttttggttttgtggctctcaggtctctcagctctctaactggatccccactctgacttctgctggccgctgtttcttctgctgctccatggtgtctttccccatgattctgtacttccctttctactttttgctttctaggcattatcctcagatagctcacccactcacacagcactaactgccactgctgggggagaccctttaacagtccaccctagagctctagtggctggtctggatgacagctacatccatataatacctcacaatggtccagaaacttattactacattgtgcaataagaaatacatgggcttttgaaactaggcaggcctgagtataaatactggatctaagcataatgaactatgagcatatcttagagatcttgcaggtttggttccagaccactgcaatgaagaaaatatggcaataaaggaaatgttttaatgaagttaatatcacaatgaagtgagtcacacacatttgttggtttccaggggttaaaaaagttatatttacactatactgtagtctgtgaagtatgtaatagcattatgtctaaaaatgtacgtacgtaattaaaatacttttttgccaaaaaatgctaatggtcatctgagacttcagcaagttgtaatcttttttgttggtgggaagtcttgccttgatgttgatggctgctgactgatcaaggcgctggttgctgaaggttgggtggctgtggcaatttcttgacataagacaacaatgaagcttgctgcagtgattgactcttcttttcctgaaagatttctctgtagcatgtatcgctgtttgatagcattttacccacagtaaaacttcttttaaaattgtagtcaatcctctcaaaccctgctgcttgtttttcaactgagtttatgtaataaactaaatcctttgttgcaatttcaacaatgttcacaacatctccaccaggagtagattcccttgcaaaagaaaaaaaaaaagcaatttttttcttacctatacaagcaactccgcatttgttaaagttttatcatgacattgcagcatttcagtcacatcttcaggctccgtttataattctagttgttttgctatttccacgacatctgcagtgacttcctccactgaagtcttgaacctttcgaagtcattcatgagagtaggaatcaacttctgggaaattcctgttaatgttgacattttgacttcctcccatgaatcatgaatattcttaatggtacctagaatggtgaaccctttccagaagattttcaatttactttgcccagatccatcagaggaatcactatggcagctatagccttataaaatgtatttcttaaataataagacttgaaaacggaaattgcttctcgattcatgggccgcagaatggatgctgtgttattaggcatgaaaaaaacactaatacccttgtacatccctatcaacactcttgggtgaccaggtacattgtcaataagcagtaatattttgaaaggaatcttttatttctgaggagcaaatctcaacagtgggcttaaaatatttgtaaaccatgctgtaaacagatgtgctgtcatccaggctttgttgtcccatttatggagcccagacagagtagatttagcatggttcttaagggcccttggatttttgaaatggcacatgagtactggcttcaacttaaagtcatcagttgtattagcccctaactagagagtcacccattccttagaagtttgaaagcaggcattgacttctctctagctgtgaaagtcctagatgacatcttcttccaatagaaggctgtttcatctgcactgaaaatctgtcatttagtgtagtcaccttcattgatgatcttagctagatcttctggataacctgctgcagcttctacaacaggagttagagaccagcctggccaacatggtgaaaccccatctctactaaaaatacaaaaatcagctggggatggtggaacacccctgtggtccccagctacttgggagactgaggcaaaagaatcccttgactctgggaggtggaggttgcagggagccgagattgcaccactgcactccagccttggtgacagagtaagactttgtttcaaaaaagaaaaaaacaacacaaaacaaaaagaagtatgcctgtatatcttgtgttttgatcaggacatatttggttgtatgaaaatccatcctcactagtaaagaggtgttttaatttagagaaataaggagcatcttacaggcatcaaagagcaagagacaaagtatataggtgggctgtggtgttcaaaaacctgtctacaaattacttgacatttcttcgtcaatagagcgggtctttttcacctcccctaaactactgctggcctccataccttgctgctgaatgtagaatgcatcaggagtggatgcctcatgacttcctaggctaggtcataaaaggcaatgcagcttctgcccggctctctcttggcagacccagggctttggaacattgagcagcttccaggaagacttccaggtttctgaaaccaccttgaaggagagaccatgtggaaagaccatgtagagatagagaaagatgcctgaggagcccaagttgtttcagccccacctatgtgatcttcccaactcaggcctccaagatgcaagtgagccatccatccatccactgattgcagcgccagccactgtttgatggcaaccacatgacagacctcaagtgagaaccacctagctggtcccagccaaccccagaaatgtgggaaataagaataatatgattattggtctttcagactgctcagttttggggtgattgttacagatcaatagataactgaacacaggttgagagtataagatttggaaagctgagtttatgccctctgtctctgatgaggctatgaggccttttgtccttgcatttttctgtgccctatgctttcttcatctgcatctctctgcagctgagatttctgttgcttaggactcctctgttctccacaacttcagctttgactcatttggctctggctttggtattgaactcctaccatctcctaccggacccaaactctggttcacttggttcagatcctcagtagagtgaacttgaccacctcaccatggtctatgagatagatttcctgggtgagatgcctcaaggtggtcaattgtggctgagagctgcgtgggtggggatatcagtgtggtagcaaggatgcaggcaggttaaaatgttttagacaaaggtgaggatgggaaggcagtggtcagcatcttaagctcagcttgaaaaatttcttttccttttttgtattcataactaaaaatttgatgttgagggtaaataggcagagatgcttaaattaatttctcagagttttggttataaaatgatgatctatgtataaaatatccaatacagatgcctggcagatgaaagacaatcaacaagattaacttctccctgccttctgcctttcttttctcctctctaaaagacaaaaaaattctaaaatccaattccttgtcttagcattttaagttgcattcctttcaacctcatcctcctccaattctctgctgaaccttgtaccctggccaaacagttcattttaaataatccaggaaataatggaagatttatcatgctttcttcatcattgcacaagtgattttcatacagtagtttctaaataaacatttcaggatggattggctgttgataattcatctagaagtcatataaatcatgatgattggtcgttcagagccaatccctgactgaccaatcatcaatttttcagtgtctgtggctgagtggatgaaattcacactctcaccatgccttacaaagccctatgtgatcttatgtctgctacctccccatcactgctcattaatcttcagacaaaccttccctttccttgttttttacacagctccttcctgcatgaaaacctccatccatactattccatgtttctgaaacattcttcctcttacctcttcacctgggtatcttctgagtcttaacttaaagatcactttctcactgcctcctccttctacatcacactaaatcatgtcccttattctatcttattatgggacctggaactttccttcactacattcattgtaatgacaataacatcaatatatatataagctgatttatatagtatctatacccaaccagactgcaaacaacttgaaggcagtggttgtgtctgtctcattcacagtcgtacctctgatgtttatcattgtgcttggctcaacatagacactgagccattatatgaataaaagaagatggtcactaacacttatatgacgcttacagcatgccaggcatattgtaatttcatttaataagattgagtgaatgagtgaatgtgcataatgtaaactattctcctgatttagaaaaaagtcagtattttaaagccttcacacactatagcacacctcctaggtgctcagtggatggtatgctatcaacttactttactgagtttgacagcactgtctaaagaactctctgagactctctgtgtagcagaagaaattacctagtgctgtcattgtgattctgagtgaaagagggcaggttgggttcaggcttttctccacgtttcagtctgtggtttgctctggtttcctctgacctgtaacactatctgatagaagattctcaaggcctgatcatttttagatgtttatttgcccctctgcttgctaagatttcatgcctatttatcacctatgctaaagaacagggctagctcaccagaaaataactgacagatgaggttgtgtaatgagaaaattagaacttcatgactcccgtgcaagcttagagtccatcgtaatagcttggagcttgcagcagcttctgagtagaagggagacctgattctaggaagaaatatgataattggagacccgggggaggtcgactgactttggccaagtaagaaattaccttcagttgttctgttactgtaattcagcaactccaattatcacaaggtaataaagtgtacatgtccgaatccattaaaggagctttaatgaaatcattatacctatgatgcctaattatagttggtattactcctatgattagtgtagggctagtgaaatataaggaatcaaagaatgggccaattaatacaatatgtgaaaattctcccatgctgcttcatgtttagggtgaggattgggcatttccctggggcagagagaagcacaaagcagaaaacagctcctctgggagggaaagaaggagtaggtgcttctaaactctggactgattattactcaagcagtgaatctgatttgaagctttctggttgccatggcaggtaaggaaacagaaagatacacaatgttcatttcttgaaaacaggcagcacacacatttatctaccaaaatgatggcattctttaaatttctgcaactttattcaaatagaaatttatcacttggcttctggtagcttcttccttctctaattcctttatggcctctcctcccgactttgagctgagcaccaattcatctcctgttcttcctccttcacttctctttttcaatctgtagaaacagggaagagtttggttgaaaattgttttttcgtcagcacagaggttcttccactgtctttctgagcctcagttttctcttctgtgaaaatggtgattatgttatctctttagcagggctgtttacataatcagtgcctattccacaaatgtgtagtgagtgctttctgtgtgcagggctgtgcttgtataacagacattgagcataatatgacatagttatcctcaactgtaagtgtaggaaggccgtgaaggcactttgttcaataaataaataaacctcttgcaaacagatatatatatatatatatatatatatgtatgtttaaaaacaggccaactactttaaatcagcaaatttcctagacaatgccagaaatgctcaccatgaagacatacattatatccctttatgtctaaggaatattttgctatacattgtcataaacacaggaatgattatgtccatgttatagatgagaaaactgaggacttgagaggttaattaacattgaatctgaattagcagcagcatgtaggaagtttatctccctggttttctcaaatgggggatgcatatgattttcataagtgctatacaattatttggggcagaatgctggttgttgacttttaaatttggatttatatcattatatgccactttctaacccctataattatttttaaattatgacgtaccataggttattgtaaacacaataaaaccccaaagtacatatgaaaagtgaaaatgtgaaaacccctgcacccatttctctcctgtatcccatcctccacagatgatcactcttcactattttggacaccttaggtagactggagattctgccagaattttgaaacattcgataatgtgatgaacctagaaatgccaaccacttcttccagtctgatgggcttcctgggggagttatgtgctaaaagcagacacccagtgggagatacaaaactgccttattagtagcagagacagtgactgatatctaccagtgcagaagtctgcactcccacttggaggcaggaagcaaagaaccacccatgtttttaatgcagtgacccggcccattagcacccttgtttaatcagtgtcttaggttttggtcagttagactggagatacctcttccctttggggaaggtaggggagagctgtggtggcggtagggtggcttgtagcatctttttttccataggattgtataaactagcctggactggagtagtagcactgttcctaccctgcagcccaggtcttcctacatccccacagttctctcttgactgcaagccatagaaagcctggccagcagcatttgcaccagctccagcatcttatctcccggcttctctgggcagtttccctctagacctttcctggccacagtctggcttctgactctttaaagaccccaggtacccacccagtgtggtgtggtgctctttgaaatgcctcttctctcagccttcattttcctcccaggtttgggatcggaaactcctgactttggtgctggaagacaggctgttctgtgttctcgagtaggaagtgtctctgccaggcttgagctggcttaaaatggatctgccatacattgatagaaaagccttttggatctgttcatgcagttatcgctcacaaactatcttgtagtgtctatggtgatgccagttcctgtgtgtgtatgtggccaagtaggggtgggttgtttacatatatgaatcaggatctttcttctccacgaaatttatttcattcattcagaatttactgagcatccaccacatggcaaatgctgtgtacctacgtgctggacatatagaggtgcaaacaaagtctcatgtctttcctcacatgtcttagacactagcggagaatagagacaaaaaagtaaacatgcggctgggtgccgtggctcatgcctgtaatctcagcactttgggaggccgatgctggcagattacttgaagccaggaatttgagaccagcctggccaacatggtaaaaccctgtctctacaaaaaatacaaaaattagccaggtgtggtagcacatgcctgtaatttcagctacttgaggggctgaggcacgagaatcacttgaacccaggaggcaggtgttgcagtgagccaagattgcaccactgcactccagcctgggtgacacagtgagactttgtctcgaaaaagtaaaaaaaaaaaagaaagtaagcatgaaaatacaaaccatgatcgttttatgctatagatacaagaggtttctacttacaaagttgtattcacatttcttgagacagtgtggtgtggttggcagtgcatgaatagcttatctacattttctaagctttattttgtattttcaactacaaatttaaggtcctagcttgaattgaatcatagctggtaccacttgtggaggtttctttctaaggactgtgcctaaggtgaaaactgagcgtagtcaaaatttcccccttaaaaacaattacaaatcctttcaatcactcacaaagtccaacatatacatagttttctgtatacattacaatgtataaattcataatttaagcaattcatgggcaatcatatatagtatttgagttgatatgcaaattttaattttgtactgtatttgtaaatttttaaaaatggctaaactatgaaattactaatatttgaacatttttaacctatacaaattataatttcacctgatccaacccaataaataactatttttctcttttgccttatacagcattaaattgatgttattctatatgggactctaactgcaaagaattgttccagagatatcatttttggggtgatagaaatattctaaaaattgggattgtggtgatggttacacaactctgtaaattcactaaaagtcattaatttgaacacttacaatgagtgcattttatggtatataaattgtgcctcaataaaactattaaacaaaatgaaagagctcaagactagacacatggatgaggtctggtatatggagttttccatgatgcctttgatgaggtatctcacaacatcccttttgagttaagtcaggtctggctactctgtataaggaaaaggctcagagggataaggtgactgagccaaggtcacacagcatgtacctagcagagcagggatggaaataccatctggcactgagacactaggctgattccatttcttttcatgcaaccgggattgggggagctcccttccttctcactatccctctgaatgctctgacatggtttgctccaaagcatatcttgggaactgagcagcctgggagtggaatgactgtggaaaatggatttgcacaactgcctccctgggcagcccactttggaaaccatttgtgacctgtaattgaccatgacgatataaaaattggaagctgaaaattacaaacatgtgaggttattagatggtgaaattgcagcttcccatcagcctgctgcttcctgaattctcagttttgcttttgggggctagagcttggcaaatcctcatgatacaccccctcccttgcctgaatgtgctccaggctacctgtttcccctgctcaggggaaaaagaacaagaaccctgatacccagctgggtgagccactaagcagaggagagaaaagcctctacttgtcccatcaggttctatcacattgcatccctttgaagctgtgcatctgatctgagtcatcatcagggctccccacttgcttggcctgacaagggcttgcaaggcctccagttacctctctgacctcatcaccctcactctaaccttaatctctccctgctcacgatgattgactaacctggctattcctccaaagtgtcagcacactcctgcctccacatgtttgcactggccgtgccctctacctgagatgctctttcctcagacatcttcatggccagctcctgcaagcctttggccaaatgtcaccctttcaatgatgtctaccccgactaccaggctctatcagccacccccagttccttatctccttactctgcttaattttttcccacattgctgattatcttccacaacaacatatcatataatttacatatcccatttaggattcattgtccacttttctcctggggatatcagctcctcgagggcagtgaaagtgcctatttgtttactgatacatcctaagtgctcacgaagagtgcaaattaatctccaataaaacttcgtggcatctttttttaatgacagctttagtgaggtataattcacataccatgcaattcacctatttaaagtgtgcaatttaatgttttttaggatgtttgcagggctatgcaaccatcaccacaaattgaacattgtcaccaccctcaaaagaaaccctgtaccctgtagccatttttcatttctctctaacctcctgttaggagaggcagccactaatccactttctgtctctatagatttgcctctttgaacgtgttatataaatggaaccatgcagtatattttgaagctttaaccatgttgtagtgtatactagcactttcattttagagctgaataatattccattgtgtgagtatattgcattttattgatatattcattagctcatagatactagggttatttctactttttgacttataaatattgctgctatgaacattcacatataagtttgtgtgtggacatatgttttctattatcttgggtatatacctaggagtggaattactgggtcatctggtaactctctatttaaccttttgaggaactcccagattttttttaatggctgcaccattttataatcttaccagcattatatgagggtcatgttatgtgttttaaaagttaaacacctcagtcaacaaagagatcctaaatgttttgctgaataaaatattctgatgtcattcaaacacatgtcactgtgtttctttcaaataggtatttttgagatgacttttctcccttctcccttctctgtgtgtttcagactcccattccctagaaacattgtgaaagaagtcttgggaattcgcagggatacaaggatgcctttgaaactgatgtattaaactaaagtgaggtggtcctggcctctggtggctgagcacttttgtgcagtgtggcccttataaataacagggcctggttgtaaattgtgattctgtagtctttttccacaacgtgtagaacagtgctgtacataaaagtggaacttggacataacaggtgttcagttattatgttttaaataactggctgaagtaatcatggcaggtgtactctcagatgttgggagtgctcaaaatcgacttacttcctcaaatatttgttgttccttatagtgatgagggtagagcaaacattgttggtgccatgctcagatccccctaccttcagcccacaccagaggttacctgcaaactcttccggtatgtggtggcagctctgagtctctgtctgagggcattttttggtcacagatggttgttcaccatgcatttggagcagccacaatttctggggaccccaggaacaactcaatcaatgagggctggaagttggtgataaataccccagcttacttgccagccagttgaggaaaaatccttggatgtaaccacagtctcaggatccctactgggattgggcccagtggcccaaagtgggaaccagccctcttttctggcttacttttacttcctgtcccattccccactccctcttggggctattgggataacatcacaaatacatgactgtcacctgaatccttgtcttagcgtctactcctgatgaagcccaacccaaggcaacccttaggattttgtattcatggactacctggctggtcagcagaaagcagctcctggtctgtggtagtcctgctgggcatctggcagtgagtaaagatttgatttgaatttgcatgtcagagatttggaattgggactaatcagctgtgactggcgattccaggaagcaggaactagagggaggacagatggtattatgagtgcttgtgagggggtgaggcagcatgtgggagggacaatctgagactcagggattatgcagagtgtccctcaccaggagtattagtttgttttgcattgctgtaaaggaatacttgaggctgggtaatttataaagaaaagaggtttatttggctcatggctctgcaggctgtaaaagcatggtgtcagcatctgctcagcttctggggaaacctcaggaagcttacagtcatggtggaagggaagggatagcagccatgtcacatggtaagagagagaggaggaggttctagactctaactctttagctcttgcatgaactcattacaaaggtgagagcaccaagccagtcatgagggatccacctccatgacccaaaggctcacttccaactaaggatcacctccaacatttgggatcacatttcaacatgaaatttggaggggacaaatatcccaaccatatcactctgcctttgggcccccagatctcatgtccttcaaacattgcaaaatacaatcatcccttcccaatagtcccccaaagtcttaacttgttccatcataaattgaaaaatcgaaagttcaaagtctcattttataatcaagggaagttctttccacctatgaatctctaaagttaaaaacaagttatttacttccaagattcaatggtggtacaggcaatgggaagacatccccattctaaaagggagagattggccaaaagaaagggcaacaggccctgtgcaagccccaaaccgagtagggcaaacatgaaaccttaaagctccataattatctcccttgactccatgtcctgcacccagagcacattggtggaaggggtgagatcccagggccctgggtagctccgcccttgtggctttgcaaggtgcagcccccaaggctgctgtcatgggttgaagttgagtgtctgtagcttttccaggctgaagttgcaagctgctggcggctctattgttcttgggtctggaggatggcagctccttctccacagctccactaggcagttccctggtgaggactctgtgtgggggcttcaaccccacattttccctccacactgccctagtagaggctctctgtgaggacttcacccttgtggcaggcttctgcctgggcacccaagctttctgttccatctgctgaaatctaggtgaaaggaaccaagcctccttcactcttgcattgtgccagcctatagacttaacaccacacagaagctgccaaggcttatggtggcttgtgctcttcaaagtggcagcccaagctgttccaggtaccctttgagccacagctggagctggggcagctgtgatgggagtagcagtctcccaaggtgacacagggcagtagtgtcccaggcctgggccctgaaatcattctttctctggactcgtgatgggaggggctgtttccaagatttctgaaatgccttcaaggcttttttcctattgtcttggatattagtacctggatcccttttagtcatggcaatctctctagcaagtggttgcaccacagcctacttgtattcctctcctgaaaatgctgtttctctatgacatggccaggctgaagactttccaaatgtttgtgccatgcttccttttaattagagagaaaaaattggtaccaggagtgaggcatttatataaagatacctgaaaatatgaaagcagctttagaactgggaaatggcaaaggttggaagattttggagagctcataagaagaaaataaaatgagggaaagtttggaacttcttagagaccggttaagtagttgtgaccaacatgctgatagaaatatggatggtgaaggctaagctgaggcagtctcagatggaaatgaagaattattggaaactggagcaaagtttgcccttgttatgccctagtgaagaacttggctgcattgtgcccaggtccaagcaatttgtggaagggtgaacttaagactgatgatggaagactaatggaagaaatttctaagcagcaaagccttcaaaatgtagcatggctgcttctgacaacctgtgattagatgtggaaacaaagaaatgacttaaaattggaacttatatttaaaagggaagaagagcgtaaaatttggaaaatttgcaagctggccatgaggtagagtaggaaagagtattttcagaagagaaatacaagttggctgtgcagcaaccacttgctagagatatttgcaagagtaaaagggagccaagtgctgaaaacgaagacaatggaaaaaaggcctcaaactcatttcggaaatcttcgaggcagcccctccaatcacaggtccgaaggaaagaatggttttgggagtcagacccagagtgccactgccctgtgcttcctcatgacactgctcttcacatcttggcagctgtggctccaatctcagctcaaagggtcccacatatagctcggggctgctgctctgaaaggtgcgagccgaaagctttggtggtttccatgtggtgttaagtcttcaggctggcagaatgcaaaagcgaaaaaagcttggaagcttccacctagattgcagaggatgtgtcagaaagactgagtgcctgggcagaagcctgccacatgggtggaacccccacagagagcctctactagggcagtgtggaggggaaatgtgggattggtccccccacacagaatctccaccagggaaccgcctagtggaactgtgggaaggaggctgccatcctccagacctgagaaagctacagccaccagcagcttgcaacctcagcctggaaaagccacaggtattcaactccgacccatgagagcagccttgggggcagcaccctgcaaagccacagaggcagagctgccaaggccctgggatcccaccccttgaaccattgtgctctggatgtgggacatggagtcaaggataattttggagctttaaggttcaatgtctgccttgctgggttttggacttgtgtggggcctgttttccctttctttcagctgatttctccctttcagaataggaatgtttacccaatgcctgtatcaccactgtatcttggaagtaaataacttgtttttcattttacaggctcacagctatatcttgagtttcagaagagatttggactttggatttttcagttggggctggaaggagttaatactttagggaactaaaggatgattgtattttacaataagagaaggatatgagatttggggcgggggagggggtcaaagacaaaacaatatagtttggatgtttgtcccttccaaatcttatgtcaaaatgtgatccccaatgttggaggtgggcctatgggaggtatttgagtcatgcaggtggatcccttatatcaaatacatttacacaactaattaagaataaaggatgaaatggattgtaaaaccttatggactgtgtgtctctgctcagatgtcagttttgtgctaccctcatggtaagttcttgctatattagttcttagagtaagttctggctatattagttcacacaagatctgattatttaaaagagtgtggcacttcctccctctgtctgtctttctccttctctttccatgtgacatgcctgctactccttagccttccaccatgattgtaagcttcctgaggcttcacagaagctgagcaggtgctggtaccatgcttgtacagcctgtagaaccacaagccaaatcaatctctttataaactatgcagcttcaggcattcctttatagtaatgcaaaatggactaacacaataggacagtgggaggaaggtacagatatgtgtggtcaggcacctgtagattcagtcatccctgcatgcaggactggtgacacaacttgtggggcccggtgaaaagtgaaaatgcagggacctgattgaaaaataattgggaatttcaatatggtgatagcagagcattaaaccaagtgtgggtccctctgtgcatgggccatgtgagactgcacagggcccatgcccatggagttggtcctacctaaatatctgaatctccctcagacccacatttatgcccccgatgtttgctttagaaacatccttgcaatctttgctctgccaggctggaccctcctcactggcccctctgcccccaggcattctgccttccaatgcacccttcatactgcgcatagaatgattgttgtaaaacacagctgtgatcactttacctctgtcctcagaagtctttaatagcaccccactgactgtggctgtggtttgaaaatcgtgatgggcaggccccctcgggtgctctgagcctgctgctgagggtgagagaggttgtgctcgctgcttctctcattcccattgcaaacacagcagaaccattttttatctgttttgcatatatattgggcttccacataagatttcatttgagaacaagtttctactcctaaaataaaaatcatttgggaagctactggccgcagaattaaatccaagcttctgagcttagcatttaatgtcctcgatgctctatgttagaggttggccattttaggcccatgggccaaatccaacccatggctaagaaggatttttgcatttttaaatagttacattttaaatgattttgtaaatacttacatgatacattatcccccatttggcctcttggcctgcaaagcttcatatttactatctggccctttaagagaaagtgtactgattcctgatctagctccattatttccttccacatttaacttttaggattccagcacatttaccctacagagcctggcttagtaccttacaaagctaggacaattatatgcctggtttgttgtcctggcatcattattcatattaatagagcccttttcactctcctaagtgtctttgggaagtaaattatattgtcatcctacatataactgacaaatgaattgaattgaaaggaagatcaaaaaccaccagcacattttgtgacaaagtatattatgtttgatacttagggcatctcctgaagaggttccaagttttgtctgtttgagctaatacccagaaatgacaagcattataaaaaagaatggccttaaaaataattactatgcttctgttatgtatgtgatggatttctagcactaacgacatcttcgcttgcctaattttcttaaaaggatttaaccaatctatctgatttttaaaagcagcatgaggtatgttaacagaaacccatattgggacacaaatgcagtctcgtgctaggtattgaatattttgtttagagaaaggctatatttagggagtgggggaggagttgtcctttcatctgatattctaggaaatgaactatttttgctactttctgtgcctggagcacagcatggatgtttatctgtaacaggcccaacttttagaagatgccaactccaaatgacctggatattatccaactaagtgcttttaaattcccagtaataactaaccaagcatgaagaataactcaattttggatgaatctaatcttatttataaacaggcgcctacagaaattctgaagtttaacataatttagaaagttgagatgcaaaagcatgcttcttaatgatcttcctgccatcctgtctttaaaaatttattcagtcaaggagcatgttcagggggcatgtatgcttccagatttcagcaccagagaaagtgcaaagaatagcttcacccattctctgtcctccaggaacctagttctggtatttagggccagtcagtgcccttggtgatatggcaatgggctgctcaccaggctgagaggttctgaaatcttggaagaggtgtattgtttgttgttgcaacaaatagcttgaggaaaactaaaaatggctaaaagagtacagaatgatgtggatgatgtttttattcagggtggtctgggaaggcctctctggggagatgacatctgagcagagtgagtccatagggtcttacaatccatttcattcttcattcttgattagttgtgtaaatatatctggtataaggtccctgaattccttcaaggaggctcagacctcctccctacccccaaatactaaaagagaccagttttttctcaaagcccaaaagaaataaatttcaaatactgctcaaaagaaactttagcccctgttaagtctgtcagttgccttatgctaagtttatagtcagggtcctctcctacgagtaggtgatgaaaaggggttggaaattcacccaagggaataagtacagaggaatggtaagaattgactctggaatgagagagcaacctcctagtgttcccactgaaataaggtggctactactactaacaactcacacttgttgagtatttacgtgtcgctgagtatttgcctgtgcctggtactgggcttgacctttccattctttagcctggcacatccctccccaacaattttagagaagtagagaggtaggctatcagctgagcagagcccagtggggtttagaaggcagagatggtgaaaatgggccgctggactgtaagcttcatgaggatagggactgtatttttttttcctcaggatttagcacagtgcaaggctattatcaatgtgcaataaatatttgttgaatgaatgaatggatgaatgaatgagtagtactagcgaaagcacagaggcaggagactaggcatgtgtagaattccatgtgtctggagtctggagtctgatctctcttccctgctggggatatcagagtagatgaagcttggagtctgaggtgagtgagaaagtgtgtggggtaaagttggaaaggtagattgggacctggagtggagacaatgttatgaggacacagtttctgtttcctggagacataagaagactgtatttcccagcttcccttggggttagactggtgccatgtgacaattctgaccaatggcctgagtggaggtgacttctgggctgaggcagttaagagcacacaggccacctccacttctctgttctcctgttgtggtgaccatgaaggtcacctaccatgatggcagagccacaggggtagcagcctggatctctgagtcactgcttggaagatggctacttaactagcactagacttttagtgagggacaaatatatctttgttacgttaagccactgagattttggggtttatatgttactgtagtatatcttattctatcttgactaatgcatgaccagatttctgggggccttaaatgccaggctaagggctttctgctcttagagagcaaaaagtgcaattgctgttgccagcagtcctcctacatactcatctagagtaggtccacatgtgtgggggaacctgagggcttatccctgctgttggggcaagtgattcaatgccaagagagcatgactctctacatgcactcaaaagatgagtaccaggtaagttctcgttgagaaaggccttctcttcttttcctctgacctgatggtctttgtggcagtccaagtatgttaggtgggcatcagaagtggtcctggcaagaaggcctgatcagaaagactaaaaatgaggtcaggctggttgtgaaatttattttgggatgttcaaagtggctcagactgcagagtctgcgtgattgctgatagagaggcatctcttttgtgttaagacactgaggatggagaaaagcagtggtttcaatttaatctccaaatagtgtttttttttttttttaaataaaagcatgtcacatgaaactactctgcaccttgatgtttttcactcagtgcctatcgcagaccacctttcccctcattctcttcaatgggtgcttattctctcagaataggcataccaccctttctgaagacattcccctattgagggacctttttatttttgtctctgattcctcaatattataaatgaggctacagtaaacactcttgtacacatcccctgaacacatgtccagtgtttctgtagtgagacatctgggttggaaggtatgagccctttttgtcttgataggtactgccaagttgctaccttaaagggctgtgatcatttatgctccagagattggtgattttgatagaataattctcctgaggaactcagcccctgcttcttggtcaaggatgagggagccacagaccctgtggaacacgtgtttgcctccactcctctcatttaatctgcagcacagattcttcacgggagtcccttcccatgggtgctccccctccacaaagctcacatttaagtcctgaaaaatgagaggacttaatccagtctctatcagatctaaatcagaacgtttttccccttttgccattttaaattacctcttagctcagccccagactgagtaattcagagttaatgggatatgaaagtcatggtccatggcatgattgtgggtacctagccagagggaagcaagatttattttcttggaacccaactgggttgaaaagggtgataaatcagcagggctattgctagctccccttctgctgcaagtttcattccagcttatcagaataatcatcttagttctgagacaggagataaacagccaaatccagagtcccactatgtggtaagagggagagatgtctttctgaagtctcttttcctaggtatctttggatgggggtagggaacatgttatcatcaaactgcagtccagtgaaaagcatcagtctgtatttgcccaaggcacaggcttggattttgtgtccatgaacacagctggtttgaggtttctggtctacttggggatgctgtgtaaaaggtccttggaattgcatgctgattcactgtgtcctgtgaactgattgcagggacacacttctccatgacttggccatttctctctccgttattctggctcttggttcctctttggttgttctgcaggggtctagcaatcattcccacagagaacactatactggttttgtggtcattctctaggtgttcccttgactttgtgaccaatcccactggtgacagtattataatgtggggctcatggagcaaaagtcacagatatatatgcctgtggaatcctaaggggccacagcttacacaagtacacacagaatcaccttaaatagtaacctgaggctgggagtggtggctcgtgcctgtaatcccagcactttgggaggccgaggtgcatggattgcttgaggtcaggagttcgagaccagcctggccaacatggtgaaaccctgtctactcaaaaaaatacaaaaattagctgggtgtggtggtggatgactgtaatcccagctactcaggaggctgaagcatgagaatctcttcaacctgggaggcagatgttgcagctagccgagatagcgctactgcactccagcctgggctacaaagtgaaactgtcttaccaaaaaaaaaaaaaaaaaaaaatagtaacctgaaatgtcaaatgctagcagtggctgaattctcactttggcttatgctaagctgctttataagtattatctcattttatcccccaaactgttctgtgaagttgacgctactattgcactcattttacaagtgagggaagtgatgcctggagaggttatcaatggcttgttcgagatcacagaactagcaagggaccacagagcttatgttggctgcttccatgtacgtatttacacaaacgtccatttacacaaatacatatgcatgcagagatgcacatgcataaacattcagattaaaacatgtgtgtgcacacacacagacactcactcaaggagaatgttcagcaaagaactagtgattgagtcttgtgattgttaattagaacaaaagcctggattcctagctttcttctccttgaagcttcctcactttgtttactgtagaaacgtaaatagaaaaaaagacattggcaggcccgtttaaatttggggtgttgcctaggaaaggctggagggctacgttctgtgagcccagtcaaaataaagtttggtttgggccctggactttggactgcagagttggatgcttatttatttctgcatcaggaacaggctcatcccttgggcagattcatattaactgaggttaagatactgagctatgatcctgctgtacaaactcatcctcctaggagttttttctggaactagattcacatgggaatgtactggaaatgtctagcctcaaaccagggtagatggtgctatgatgtttaagggcacaggctgaaatatgtccatcttatagtggggcttgtctagccagtgggactggacatcctcacaacctactgaccactggctcttctgtggacaggcctgaaacaggcccagccaacccctgcttctgggaaaacttggtcagtgcttctgcagttgaccaaccctcttccactccatacctgcttctttagagatcttaataatacatctgatcagattatagccttggccctcagatctaggatgcatatccttctattcacctgcctctgctcagtttttttgattcagttcttgctaatcttaaaaatttatttcatacatggagatcttattctcctactttccaagtcctgagggatgctatgctttgttctagtcctcaagtactgaacacattcattgcagaagatgctgttgacgccctacacatatcctatcagccagtcctggaggtcacctgcagacagtccccatgtacaccaaaggcttccagctatttctcggccttaaggtgttctttggtccagggaatatgttcagcactcaaacagggcagcatggaagtgctgggaagtttgttctccaggaacagccatcaaacaataagggcatgaagatctcagccttcttgttcttcagtggggcagcggcaaggtgtgctccataatctctcagaggcccccagtgggaatgagccccagttgaccacagtggcaacctgcctccttcattggctcccttcccctccctgtctcacttccctactccctcctagtacttcctaaaatcacctctcaaataaactacttgcatccttgtctcaggctctgcttttaaggaaacccagacaaaacagctaccttcagtctttacccaagaaccgtttccatcaattccttgttcaccacatggcccagcctcaccttcctcttatctgagccccttttgataactttgggaagcactcaatcccagagggaagagcacaagcattgaagccagacagatgtggggctgaatcttggataggtcacttattgactgtgcgaccttaagcaaattactcaatctcattaatcttttaaacaatgcagctagtgatacataactttcgaagttgtttggaagaatcaatatgataatgtatgcaaagggctcaaatgcagtgcttggcaattagtaggtgttcaataatgtcaggccttcatctctctctgaacagaggctggtttctttcagccgtggtgcaagcagatcatactcctcactgaaggcagcttggacacagtatagggcatggctgagctctgagtacgggtttgaacagtccaggaatgggactggtgatatggtagccaccttcttctccccatattggcagaccctacctctctcttctttttgactcctatgcttaaggccactcaacatttcccaaagaagctctaccctttcccagctctgctcttttgcttacctagttccgtctacctggaagtcttttatctttcccaacctcatcctctgaaattccactcaatctttcatagtgtggtataaatcaagatgcataccagattcaccaggagagctttttcaaaacatacaccttaaacttaccctcaaaacttccgattcagtagatctgtgttgaggtacaggcatgtatgttttgaaaaactttatttacgctgattcatgcccttggggaagaaatactcatatcatccagggagctcaagtgatgtagtcaaacttgactccctgtgtgccatctacttagctactctggagccccagttttctcatctgtaaaatggggataatatctatcccatatggttgttataaagattaaatgagataatagaagtggtgctcaggaaaaattagatctacattaaaccatttttgatcccccagccagaagcagtcacacactcccactttcctatcttgctatgtctctcctgtagcactgagtgcagtggtccttccattgggatcatcagtgtgagttgctcctcacccccagcccctaacttgaacatgcctgctgagggatggggacaaacagggacagtgtgttatctgtcatgtgctcccacagctctggcatagtgtctcgcatggaatctttgctcaataaatttttgctgaattgaatataaaaccataagaaactaatgtaagtggttatgttaggtacctgcataatgcgttttgaacaggcttttgattagtcttagtgtccgggaaacagtttcctactgacagtgcattggaaattgccaggagggcaatatatgtgtgcataaaattctgcttttctcagacctggacagaacctttgtttcctggggcttctggttgccaggcactcacaggggctgaggtgagcaaatcatagggctacccctggcctgcatcctcgctctggacctgttgaggaccctcctggctccattcataaccccaagacttcgaacttggctctttagagagcacgagggttgagagtcctgttttctcctctggatttgaagcccacgagtcccctgtttgtgtctcatgacctggcttcagtctccatggagagcccttcccctggctcagagtcacagctgttgctgcaggctgaggctcctgtggtgctttaatgaactcctgagactctctgggctgctgtttcccaggggagccaggctgctagtagagctggaggctgggctgcaagggcaccttccctctaagaacacagatgtatcactaaacggtcctttaggggaggggtctgggaccacatggcagcccacccagggatctttctaggagatgagtatagttgcagagctgaggatgtgttctggccaagggggaaatgaactgtatgggtacacttccaacctccaactgtcttttatttctcgtctcttctttttgataaacatacaatatctattaactgacaagggtaggagggaaggcagaaacctaatgaagatgatgggttgatgggtgcagcaaacccccatggcacatgtatagctatgtaacaaacctatacgttctgcacatgtatcccagaacttaaagtatagtaattaaaaaaaatagaaaaaacaagaaagaaaagtaattttctatagtttcacaacccaaagttaaccactattgacattttgatgtaggtatccatgcatgtaggtattcacacatgcacacatatgtactatacaagagcatgtacataatatacatatgcatatatacacataggtacatatgcatgatatatgtataatgtataggtgtatatatatcacacatacaatatacattggtatataaaatatagattataaataatatacactataaatagtatatttgtaatgtaaataggcaatattacacatgagtatatataacacatataatttacagatatctgtgtatactattcataaggatataatatacacttaagtatgtatgtataatatacaatatatagatatgtatcatacacatctaagtatgtaagtataataagcattaagtagattatatatctatgtactacataggcatatataatatatagacatatttataacataggtatacatataaataccaatagtctacataatacaggtagacatataaatctaatgtatagatatatatgtgtaaaatattatatatggatatacacatagccatatgtatatataatatagttaagtatatatgtgcataatatataaatgtttatataatatacataagtatgcatgtataatacatgcagatgtatttatatgcctaagtatatatgctatacatatatatagtatacatattttatatggaatcatattgatttctgagcagccattcttttctctccagcaaagccagagaggtgttatgaaaattccagactgatcacatactttcttaaatttatacatcacctttccctattgtattttcgataaagaccaaaatccttaacttcttctgtgaaggtctgtttttctgaccctcctgtacatactcacttcttccgcagcctcagagaacactgtccaaccatttgatccctcggtttgcacccctcattctcccccactgtgcctggacaacccttattcatctttactcaggaattcttcatctgaaattgagtcctctgtcaggcatccctcagcagcctgcatttttttctatcagaatattcaggccttttaaaaaatatctctcccctgccggacagtgagcctcaagggactctgggggtcctgaccagtttccaactgccatcagtgtcaggctgtcggagagccctttataaatacttgctaagtagcagatgacaattctgttcttttaaaaattcactttcgagcatattgtgagcattttccatgtcaagaactgtattagctagctacattatcatttttagtgacatcacatattccatggtatggatgtaccataattaatttaattgatttcctattgctagactaaggttgcttctaaatgtattgttgaaaacagtgttgtcattgacattcgtgtgaaacatgtaactaatttgcctgaccaaaaaggttgcaccaacttatatgtattttcatcagcgaagctgtcttttttttttaacacacccatctctacactattattattattgtcaatttaacagtcatagttcaaagttgcctttctctgataactaggaatatttgttcattcattctacactacagatacttattgagagctcactccatattactagcaaaatgaacgtattctatggccagtagcacattgttgcagaacaataatttaaaatacagtagggaaaacctcctctctctctctttctttttttttttttctgtaaaacaccttcttggttactattatgtgtttattcttctcgataagcattacagttattttgtcaaataccttttaaaaaaactctttagtgactctgatttgaagtgcatgaaatttatagatttaaaaagaaataaatcttcaccatattgagtcctcccacccaaaagcacaacatgagtttcctttaatgtttctaaagtatttcttaaaacaatctctcaaatctgactactcaaaataaacaatattaacatttggctaaaacatcttattagatttttgaaggcatatgtattgacataaatatataattttgcctcagtgagatgcccgtgctgtttttatcaacttacatagaaattgtgtatatttaaggcatgccacatgatgatttgatacatgtatacattgcaaaatgattaccacaatcaatcagttaccatcacctcacatagttaccatttttttgtgtgtgtgtggtaagaatacttcagatccactctattattttttgcttttatttttatgttttgagactgagtcttgctctgtcacccagtctggagtgcagtggcacgatcctggctcactgcaacctccacctcccaaattaaagagattctcctacctcagcctctcatgtagctgggattacaggcatgtgccaccacacccagctaatttttatatttttagtagagacggggtttcgccatgttggtcaggctggtcccaaactcctgacctcaagtgatccgcctgcctcggcctcccaaagtgctgggattacaggcgtgagccaccgtgcccagcctagtgtagcattattaagtatagtcaccatgctgtacatttcattccctaggacttatttatcttttttttttctttttttcacacagggtcttgctctctcacccacccaggctggagtgtagtggcgggatcatagctcactgcagcctcgacctcctgggctcaagtgatcttcccacctcagcctcctgagtagctgggactataggtgtgccactgtccctggctaatttactttttgtggagatggggtcttgctatgctgctcaggctggccttgaacttctgacttcaagtgattctcccaccttagcatctcaaagtgctgggattacaggtatgagccatcacacctggtccttattcaccttgtaactgacggtttgtaccctttggccaatatctccctattttccccacaccctagcccctggcaaacactattctactctctgcttctatgcgtttgactttttcaaattccatatatacataagatcacatagtatttgtctttctctgtctggcttattttacttagcataatgtcctctgtgttcattcaaggatgctttaaaaaaactttaaggttaaacattatgatctgtaatacatatttttattgctacataataattgtacatatatatggggtgcatgtgatattttgatacatacatataatgtgtaattatcaaattggggtttttaggataccatctcaaacacttatttcttcatattggaaacatttcaagtctagctattttgaaatatacaataaattgggtaaaaaaataaataaataaataaattaggtgactatagttaagaataatttattctgactgtcctatcaaacactagaatgtgttccttctatctaactgtatgtttatacccattaaccaacctctcctcatccccccagtttcttcccagcctcttgtaatcatcattctactctctccctccgtgagatcaacttttttagttcccagataggagtgagaacatgtagtatttatctttctgtgcctagattgtttcactttgtctggttatctttttagaataaattccttgatttggaaagtttaggtcatgcatgtatttttagagatattacaaagctagacctcagaaaggttgtatcaaattgtcttccacctgcagcgtttaaaaatgttcatataaatctgtaaaagaaattaggaaaacaatgacatttacaatagcatctagaattataatgaggtaacactttacacccactgggatggctataattttaaaacaaaagatggaaaataataaatgttgttgaggatgtggacaaattagaacctttgtactttgatagtgggaatataaaatgactcagtcactgtagaaaacagtttggtggctccttgaaaagttaaacataggtttattatatgaccccacaatttcagtcccagatgtgtactcaaaagaattgaaaacaggtatcatacaagtacttgtacacaaatgttaatagcaggactatttgcaataccaagaggtggaaagagccttaatgtccatcaagagatgaacaaataaacaaattgtagcatatccatacaatggaatattactcagccataataggaataaaaaaatgatacatattacagtgtggatgaacctccaaaacattactctaaggtcaaagaaaccagacacaaagatcatgtattgtatgattccatttttacgaaatacccagaatagacaagtccatagagacacaaagcaattggtgatttctagggacagaaggggaatgtggaaatggagagtgactgctcagtgggtatgggatttgattttggagtgacagaaatgttttggaactagatagaggtggtggttgcacaacattgtaaatgtactaaatgccactaaattgttcactttaaaatggctaattttatgttatgtgaattttacctcaataaattattaaaaccaaccaacaaaccaaccaacaaacaaacagaaaatgcagtctgttagatgccatcagtcataaaagggaacctcattgactggaaatgtcttacccctgtgctctccactggaagaggagtagcaatatgacccaacaaagaaccagaaaaatcggcagcccagcaggggtaactttgcgccagaaaactagtgcccacatgccatacctctagcttgctgttttctgctataaagttattatgtgtttacctttgggaaaaagtaatgctcatgtgtcctgtgtctttgctcatggtaaatgtctcaaatctttatcagtctgagaagtgaataaaggccatttttatttgcatttctttcattactgtggagggtgaagatcttttcatgaagggtgaagatcaaacacacaatgccatgtgcattgtgtgtttgaattgcctgttgattttattcttatagatttaattttagatacggagtttacctccaggaatcccctgtctcttcccactcccacagagtgccatgtgcctgggttgtggaagcttctttcaaaaaagtttttgtgtttactggggccctcgggacttcaccaacctgggatgacctcctataataatttattagtgttgaaatctctcatcacacaaatatataagcctcgactctacactctacactgcatggtataggctttgggcttcgacttcttagggaaactttctgctttcagccacgtccctgtgcaggtgcaagcttctttgcagtttccagaacagtgggcagagttgttctagccctttccatggaggggatttttttagggtcctgattttacagcggtctcagttccattactttgctaactgggacctaaggccacatgtcctatcccaaagttggcattaaaatcccagtccctaaccattggggccatgcacccacctcctgggggggagatgtcatggttcaaacactttccattctggctttgagttttcttttcatttattttcactctagagattttcctgtctttcgagtgaacctatatattttaaatattaattattttaattcccacactcttgtgggttttcggtggtagacagggacctctgtcacggatcagtctaccaatgttgctaaaagtctaatttacaaaaattgtttttgtagtgagactattaaccctttataatatatattaccaatactttttgccaggttttaattttttttttggctttatacatggtgttcattgtcatgaagaggttttaaatttttatgtagctatgtttctctacttttccatgcattgtctctggtattatgtttagaagacatcttctttcctaagagttaaaaaaaaaagcatttagtcttgttttcttctagtgcttttatttatttatttatttttaacattaagctttctgatctatttggagttggttttgctgtgctgtggaggcagggactcagcattaatctccctcactttctggctagttgtcatgacactatttattgagaagcccattgttttcctattttcatgtgtacttaggtttgtttctgaactctaatctttcactacatcagcaatggactgttttaattacaacacgttgacattctagtatatccaatttctcctcttccctgcctctttgtcttgcccccacccccgcttatttttttaaaagaaaaaatttggtctattcttatgtatctcccctcaatcaaatccaaaatcatttaaatcaaaatccatgtcaatatcattgaggtttcttactttaacaaatgtatagattgatagagacaatccctcttgttttctgataatttattgtttgctcataggaaatctgttgggtttggcaaaaatggggatatggaccctagtgaggaggcacagacattctgagcatggcattactttaagacaagcttcagttgcaaagagtgacgttggatccctgctttcaagcttccttcaaacccatccttttacccaggcctagcccctgactggtctcttcctgtgactgaaccaatgattttaccactgtctaccaaatcagccaaaccaggcatctgggtggtgggggacagcattcatgcctctctttcctgattgttcatggatccctgtggattcaacctcctgagcagctctccagttgtcctttcctctccatgcccactgcctctgctgtgattctggtctcagccttctttgtatgggatttaccgcagcctcctcactggacttcctgcctgcagcccaccttccaggaggacacagaattatgcatgttctgaagcataaatatatgttctttcccagcttaaatcctttccatggccccttcatgaagctgacagtgtagtaggtggagacatttatttatcctttcaatgaatatttattaagcagttacttacgataggacctaatctaggccctggggatattgctgtgtataaagatacaggaatctctgcccaaggccggatgttgggtgggagaagacagaaaataaacaagagaaataatatttaaagtagcttggttgggaatagataccaagaagaaaatatgtcagggaaaggggctaaggaattccagaggtagagagggtaggggctttttaaatggggtagccagaaaaggtctacctcagaggtaatgttggaatataactgaaaggtaaggggaaagtcacggatagcggtgttcttgttcagggccttgtggaccactgtgaaggccagctttactggagtgaccggggaagccagcagagagtctgagccaaaggaggacctaatttgacttcatgatctcgcttaggttttaacaggaacactatgatggagcatagaatatagatgagtatacaagtgactgaatacttgcaaatgtgacaagagctaggaaggagagttcagggtgctttgggagtgcagaacaggagaccctgattcagtctggaatgggtaggtgggagctcaagtacagctcaggcagcatgtgggctttagggcaaaggggagtcattaaagggatttgagtaagggcaggagatcagccatgcctgtgagtagacaggatgcttatcacaccccctgacaggttatgctttgggaggtttccttgggtgagggagcctgatgcactcatctggttgtggggtggaggactgcaggggcctggagagggctcactgtgcttgtccaggctcatgggaggcaggctggcaagccaatcaatgcaatcaagagtgaaactatggttggtttgggcctctaagttttggggtaaaatttcacacattgataataactggaacccctccccactcttttcatggcttctgtgtggtggaatatacttcctcacccctttgactttgaatttggccatgcgatcgatttcagctgttgggatgtgattggatgccatgtgccctagatccaacccaaagctggaaatgtgctcagatgatttggccagccctcttgctcttctgggactagccatggaactggctgtcccaataactgctttccttaatcctaaaatgagggacacatggaaatgacgtgaatttaacctgcagcctgaagcagagctgcctcagcacatacaggcctgtgagtgagaggtaaatgcttgtcgtggtaaaccactgaggttttggagttgtttgttatctggcaccatcacagcaatagctcactaagataaagtagttgggtaacactattattttcattttccagatggtgaaaatgaagcatagaaaagttaaattaactgttcagatcatagctagtaagggacagtctgcttggaactcaggaaatcacttataaccattatctccagaaaagcacatgcacaaatacatctctcacaggcctaagtgtgtttccagcaatgctgctcagtccctggcctataaatctggagaaactttagttcctggaagagccaagaccactacaagaaataaataaccaatgaaaacctgttttctagtgtctaaagcatcaaccttgaaacctcagctgattttagatattatcctccaaggtgcgcagaagagagacaggtgttggcagtgtagaaaaaccatgttgcggctcaaatacacaaggaaaccaggcagtgccctgcttcactctctctgtcttggcctcagaggtggggcatctttgaagcgtaatgaatttatgcacatttttgtgcatttaattgggggaaaatatttttaaatgtctatcactgtgttgacatcgtgtgtctgtgtatgcgtgtgggtgtgtgttgaaacaacatcattggaagatagtgtgggctaaagaggctgggctttggagctagacatcctggatttaaatgaaaacccccttgtgtgaccctgaataagtctgacaattcctctgagtcttggatcctttatcctataaatgggaggccgtaatacttgagtaaggaatgggattggctgccacaaagtcaagtatataaagcacctaccaccttgtagggctccaagaacatttgcagcctttccctgtcttgtcatctcttataaacagtgactaccaattgaagattgtccaacttgaggacttctgtgaattctgctggcatctggaagctgcttccacccagcggacgaagcaggagagagagctcatttgtcagtcaggacatggatcctgcagttctgcatcttcaagtctacaaccctctgtctcagcactaaaaagcatttaagcacaatagagcttaaactaggagatatttgaagctgggttgaactcctatctttattatttattagctttgtgacttgggtaattaaactttctatgccttatttattttcctttctataaaattggcataatatttgtatcctgtttaccaacatattatcagcacttagcatggtgcctgccacccagtgtcatgagaatcaagtgaaatgatgcataaataattatctagcatatagtaggcacttagttaacactggtttctgtagtgatactgttggcataaaggcaaagctttttaagacagggagctcaagaaatattaactgaatctgagtggtcactgcattagtacactgttaaatcctttttagagttccctgattacattttgagaaagctcagggtctagactctataaattggaatttgcagagctgggctctgtttgccttaagaggcatgactagcttctcttcttggcacttcttattctgcatacctgccatgcttccttcaacccaatggcatttgcatatgctgtgagtgcaaaagtccatcattattatcatcaccatcattgcaatcattatcaatatcattacaattaacactatagttctcataatgaccaccatcaatatcatgatcatcaccataatcaccactacttctatcatcatcaccagtagcattgttgtaatcatcatcactactaccacagtaactattgctggcactcccaccacttactgagcccttacattgtactatactagctgatgaaatactttgtcttatgaaatctttataagaaatctcttaaggtaagtacagttagtgtctccattttgcagacaatgcaaccaaggcacgtgagtgtgaaataattagcccaaaattaaccattggtggagacataattcaaacccaggtcatatcactcctaggctagctctcttaactaataaatgaaatggcttctcctcactccttatgtagttaactcacccgtcaaatctcagcttaaatgtcccatccttggaagtcttccataactgccttcatcaccgttgtaagcacacagaattccctttaagttttcttcatagtgcttatcacaatgtgtaattttagatttattttcacaattatttgattgatagctttctcctcaagttgcatgtgggtaggaatgacagaaactgggtttctgttgtgtgccttcttgtgccgtgcccacagcaaggagactggctcagagtcagtagtctaaatattgttgaatgaatgcatgagccctgcctttatcactagtctagctatgtcctgctttgcacttctctggtctttgcaagtcaactttatttctaacttctgttttggtatgccctctgggttcttactagagcaagtgtcattctccttgggtcactattagctagatagactctgaaaatggcttagaaacagggggtcattgagaatgaataggttggagtaaggagaaccaggaggcagggagactaggctgttgtaataataaaggcttggcaaagaggccatggatggatgaccctcagtgacagtggtggtattagggatcagagttatagacaaagctaaaaaatggtatagggcagaaatggtgggacctggtatctggatgaggggagcagatggatgtgggctgccatcagcagtgttaagatttcaacttcagaggaagaataaagcatggtgccattgaaatctgtagccttgatggccatcccagccttatctccctgcatgtgatgggcccttctacatgtctgtggatttgcatatgttgttttctttgtgttgttctgtcctttctctcctttctctctctggaaaactcctactggcccttgatgacccagctcaacggacttctctgtcctttccagtggaggttattgctggctctgggctgccaacaaattttggtcagatcttttctataccatgtgccatgttgggatgccatcaccccaacatgtctgtgtgcccatttgccccatcagctatgagatttttaggagcaggctttgcaatgtctttctttctcccttcttcctccccttcagcctggacctctctgttcctctcctccctgcttaccttcctttccctccagtatgtatttaactcctgtaatgccataaggtggcaagtgctctattaatgaccagaaccacaatgaagagagactaaaggatcggggatcaggggtggtgggctctggcttggctgatggtatccttagctgagatcaggaagagaaatatgtagtctttaagagagcaaacaaccctttttgtttgtgattaggtgagaccttcagcctggatcttttgacatgaaccatttgatttcctgacacactgtgtttcgcagtgtctgagtttgggttcagaccattgcatccctcttatggggtgagcagacaagaaagtgagtttagcaataaagcccctctgccatgtgttttttttcaccttaactatgttatttatagccaaggtgagaccagtagcgagtggtgtggcactggcctcacactctcccctctgctggttcctgactgggaaatctctgaagagctgggtgctaaaccctctcattcagtgacatcatcattcttttgctacagcccatttagattcctggcattgagtctaggatggaagttaaggtcctgcacagagtctggaaaatgctgccagttacccccaatttcagccgttcgctctttggccttcttgcctcttgggagctagtgttgggaccctgggacctaatcgctgactacccagcaattttctttccttctggttcttatctgttctcagacaaatctcttaatctctgttcctcagttccttcatctgtaaaatggggattgtgataatataatacctacctcacaggattgtagtgaaaataaaatgatatgctatatgtaaattacttagaatcctaccatcacataaataggagctacataagtgttagtaattactgctattactctactgtcattattgctgttgccattataattttttacactgagtgttgacattgttcttccaatcaactagatatggacaagcttaacacctttttattcaagtctcacaccaatggcatgttgttaggaggtcttacctgactcccaaacctgtaaccccaccctgtaactctcaaaactctctatcatattatgacatgtcattgtctttatagcatctatcactgtgtcacattctttgagtacttatttattgcctctctctttatcctagaaggtgagcttcattgccttctcctaggttctcagcacaacaccctgcacctggacaggtctcaataattaatattacttgttaaatgtcttcatcctacacctttttccttgtcctggacttctgtgagtttcgttccaacaactgagtcccaaaggagggagaaattgagactgggtggaattgcggagttttgatgttcactgcattgcttcctttccaccccttggtggagccgttgttgcacctttctactgcatccaggcattctactctagactggactggaaatacatcatactaaagtgtgaatgattgatacagacttaaactactaccttctcttaagagaccaaagcctgattaattccgctttccttccttataaggaaagatgtggggatggtgcaaaagtaagaagatgaagaagctgattctaattctaattaattgcatagtcctagacaagccatttaaacctctctgagccccagtaacacacttgaaatgagttgctttccatgtgagttgtcatgtgtgtcaaatgcaatccctgtgtctgaaaatggcttgtctcacaaaatgctcaccgaataagctgttatcactgtttatcataacagaaaataaggagagtaactgaagtgagtgacaagttgaatatgagccagcaatgtgcctcaggggactccctgtctctctctctttaaatttaccactcaaatccttgggctgcctgagatgaggcctcagggcacctgctttcccccatgtcttcttctgcccccgtgccctcactcttagtgtggcttggacaaagaactccaggtcctgcccatttggagagacaaatgatgctaagatgagctgtgtaaagtctcaatatcaagtcatcttttagttccaaggcctctttctagctactggagtccatccagcctttctcttagcagcatcatttccttccagagtctctgataaggctttttctatgtcttccccctgcttccctggccctagcttagctaccctggtctgagctcctgcccctattaaccagcacctttcgtatgtcaagctgggtgccatccctaggcctacccctttccctcccaatgactaaagcttcttccattcatgagcatccactgagcttgtggaaggggcacagaacagactaggaacgtgtgtgatcaggccacatcctctatggcaaaggccttattttgtgtagttaggggagtatgtgctggagcctgattgcctgggttcccatcctggctccagtgcctactagctttgtgaatttaagcaatttatttcatcttcttgtgcctcagtttattcatctccaaaataaagacagtcattgaatccatatcaaatggtttatatgaggattaagatggatttattcatgtaaaacatctagaatgaggtctagcagacagtaagtacacagcgaatgttggcttttaaaaattattaataaagagtcactgcttccttattggcaaaccttagtcaaaggtgacctcaaatctgaggtgggtgcccagggaaaggtttctttatccctggaccatgcctctactccttaggatgtttccaagagaggtgtctgcatgaggaatggctgttcttatttcttcaccccttcatgtttccatttattttgccaggcacctttgcaattgttccattaaaggtagatgcaggtccctgccctttgagttggaacttagctgtgtgaattgtttttgcacaaaggagtgtgggcagaagcaaccatgtgccagtttaagcctaaggctgtaaggtgtcttcggtgtttttgcttgccctcttgtccttctgccttcatcatgaaaaggacatgccttggctaggcagctggtctgaggaagatgacagaccttgaagacaatggagcagactgctccagaccttcagcctagagctgctcattcatgcccacctaggcccagccaagatcggcagaatccccagcccacaggaacatgagcagaataaatgcttattcttatactctactgagatttttggttggttgttaggcaacagtagctgacagatgtacaaggtgagtggcacagaattgccattgctacagtttggatgtttgttcctccaaatctcatgttgaaattctatccccagtgttggaggtagggcctagtaggaggtgtttgagccatggggggcacacccctcatgaatagattaatttcctctttgggtggtgggtggtagtgagtgaattcttgctctattagttcctgtgagagctggctgtttaaaagagcctgacacttcctctttctctctcttgcttcctctcttgtcatgtgatctctgcacatacctgctcctcttcaccttccatcatgagtagaagcagcctgaggctttcacaagatgcccagtctttcagccagcagaatcatgaaccgaataaaccttttttcttaacaaattaaccagtctcagatattcctttgtagcaatgcaaaatggactaagacagccatgttattattgactaggcttgggtccccaaacctaaagcaaggaatggttggtgaactgggttgaaccgtgtagaatatccctttccctaaactagttaaattacattgaagtaggtcatcactgctgtccttattggcaatcgttttttagtctccacccatcttgttttatgcccaaaactaagccttacatctctttgcatgagggttgcatgcaggaaagaggcagaagagaccagtagactggcagacatgacaagttctgaccaattaagccctgcctagcagagcaccttgttgcccaagacacacaaatggaagagagaggaggcaaggctagttgagtgttgctctgggagactgtgccttgagtcacttgctattcctgctgcttggatagaagagagaaaagagaggaaaaaatacccatattaaagtaaggtaactcctccattagagggttagacccaatcagtgtcttggtgtgcagcctatatattgcaatattatggtccccttccctggaggagaagctaagtcagggaggagaaggaggaagtctggcatcttctacctttactctccctcctcatcaatctctttcctcataacctactttatgtatttgtatagtacttgtctttacctggagtcatacacttactagtttatttgattatatgcatctcccattgctagaatataagttccatgagggcgagaatccagttggttttgttcatggctatataccagttgcctaaaatagctggtacagtgtaggggattgatacatatttgctgaatgaatgcatgaactcctggagtggtccatgctggaacatatcagcttggtcactgtttgctcattgcattcacggtctcctagcatttccatgcccatggttgcaggaactaggaggccctttctttggcctcctgtaccttgggtgtttgctccagtccttgacacacatgcctgtggtctggaacctgctctgcatctgtacccctacactccaccttgttaggtgtcatccctggaccactcatataggtgatgtggtttggacccagctccctcctggccccactccacttttggttctgctgactagaaggctaattctgagtgcagcaactctgttcccagtgaagctccaggacacggtcctccagagaagtgtcccccacctaccttgcttgcctggtggggatattgacaacctattaccttatagcaggaccacggataaaccaattgcagagacaccttagtctttgtgacattttttctttcagtttggcctcctaaaagtcttaccaacttatttttattgttttagctgattctgttcctctttgctcctgcagtgattcacccaaatgcagcaacttttatgccaatggactctactaataccgtttgcaaagatgcctccgtgaaatgctcgggaacactttctctcactgctctgggaagggtttcttggccccagggtgcaaaacacaaccgagaaattttcaggtgaagtgttggctgaattctatggctgctgcttgtggtcgatcaacattcctcactcacagctgttgagcgaggctggggatgcattctttgctgtttggctgctccaagttcacatacatttttgacataaacctagtaattgctgactttaacttactattctcagcctctggcttctttctgatttatggctggagccttggggtccttcgtcagaggctccttatacttgcccattagcacttctctttatatttggcaagggtcactggtacattcctctacaggcatttatcagaagctcatgaacattacagacaactctctttctagctcatagtctgaagctcaacagatatttgtggggagaatcacaataattataattgctactaatttttgagctcttggtgtgtggcaggtactatgttattcattctttatagcaatctattaaaagaggcactgtccttatacccattttactgatgaggaaactgaggaagggagaggttcaataacttgttcccatatcagacaactggtgagaggtggagccaggatttgaatctagatcaaaaccactgcttatagccaatatgattttggaaggtaggaaggcagcaaggatggtaggaggagcaaggagcagctatcatgtgcttggtctgtgaactgagtgaagtcataaccacagagtgtgagccttgagcccttgaaaggagaatcttggcatgaagatctcatcccaggaggctctccgcaacagactgggttctgaaatccacctcccattaccgctcgcattggtctgactctggatctctacagctttttgcctctccatgaaggtgggagggtgaatttcttctgtttgctcctctggatccactctctacccttttgcacccagctctgtgccagggaggctgactgtatggagcactcatgggctcccttccttctggtttccagatgggttcagctggttggcaccagaagcagatctaagagaaggggaggagtgatgtagggatccttgctcccctgcctgcctccctgtgtctccacaggatctaggctccaggtagctggccctctctgcatggcactccctctccagtttccagtaacttcctccccttgctccttataggctagagatatggtttggctgtgttcccacccaaatctcatcttgggttgtaataatccccatgtgtcaagggtgggtctgggtggagataattgaatcatgggggcagtttcccccatactgttctcatggtagtgaataagtctcataagatctgatggttttataaatgggagttcccctgcgtaagctctgttgcctgtcgccatgtaaggtgtgtgtttgcttctcctttgccttctgccatgattgtgaggcctccccagccatgtggaattgtgagtcaattaaagctcttttctttataaattacccagtctcaggtatgtctttattagcagtgtgagaacagactaatacagctagggtgggtaagagcattccctgttactgttcctgaagttctgcattattctttgtggttttcctacattctgcctataccttggtaaatggttttttttagtaaagttcccttaaattatccaatctgaaggtaacaccttgttattatcagcacccttactgatatccctgaactttagtttgagccatttccaaccttcagatgaacaacctttacctgcacccttgactactcccaccccaactattccgtattggtgctctttcctagctctcgcagaaccattgtactgtggaaataacacaggtttctggattagtgctgggttcaaagcctgcttctgacacgtactctatgagtttgggcaagttacttgattttcccatgcctcagatttctcatctgtgaaatggaggatagtatcacttcacaagtttatcatgaaaatcaaatggcataatggatataaacttttattagtttggtgcaaaagttattgcagcttttgccattaaaagtaatgccattaaaagcaattacttttgtaccaacataatagcttagtgtctggcagataaacatcggtttaaacatccctcattttgcccgtgctctcttgatctgtaattctccagaccacttatccattttgctaagcagttccccctgggtcctgccccaagatatggccaagggaacatggcagagaggaaggaagcaactcttggctccccatgaaaggaggaatgggaggaacttggaggacagcaaaaatgacagtccaagggtttgaaataatgacacaggagaagggtaaataattgcaaaatggaagtgtaaaaggggtgatttaatactcctcttcacatacagctccagtgtgccagttggaaatgctaaaaaggagtgtttctgatatcctagctagagcaagttccaatatactagtaatatacaagtccaatggccagatgtccatggctcctacagaaatggataaagaaagccccccttaccttaatcttgtgtttctttttttttttgagatggagtttcgctcttgttgcccagtctggagtgcagtggtgtgaccttggctcattgtaacctatgcctcctggattcaagcgattcttctgcctcagcctccagagtagctgggattacaggtgtgtgcctccacgcctggctaattttttatattttcagtagggatggggtttcaccatgttggccaggctggtcttgaactgacctcagctgatccacccactttggcctcccataatgctgagattacaggcataagccaccacaccaggaccctcttgcttttcactgtatcctaacaaagctctgtctccccagtgggaagatatctcttccccacttggagttaaaagggcctgggttgaaattgagctgcatattctccttgcttgttggatcttgggagggtcttgaccacttcagacatcatttccgccagatgtggtggcacgtgcctgtagtcccagctacttaggaggctgaggtgggaggattgcctgagcccaggagttccaggctgcagtgaactatgcccatgccactgtactctagctgggcaacagagcaagaccctatctctaaaaaaataacaaaacaaacagaaaaacacatcatttccctcatcctcaaaatggggatccttgtaactactcatgagcgtagctggaatgatggttgaatcaggagcagaggatgaatataaaagatatgaatataatatagagccagaaaagcattcaagcctcaaccaatgctgatttccacctttattttcctctcactgtagcagaacaggtgccctttttcatttcaggggaaatctgaacagttcctgtcttgtatttcttaaaacagctgaaaaaattccttgatttttttttacccttcttcagctttaggactaaatgcctctaaccctccttctctctcatcaggtagtacattttgtttgtttgtttattttttgagacggagtctcgctctgtcacccaggctggagtgcagtggcgtgatcttggctcactgcaacttccacctctcaggttcaagcgattctcctgcctcagccagccaagtagctgggattacaggcctgcgcttccacacccggctaatttttgtatatttagtagagatggggttttgccattctggccaggctggtctcgaattcctgacctcaggtgatctgcctgccttggcttcccaaagtgccgggattccaagcatgagccactgtgcccggcccattttttgttattgaattgtcacttttgaggatgctcttttacccttgccaccttgtccctactcagctgtgcactaagagtgaatgtctgggtaggggtggggatggagtccagagtacagttatcctgagtcacaggaactcctattttattttatgcctttccttttgcccttctagcttccatatgaacctattgtccttcaaaagagctttgattttgagacttagactttctgcttgatctgaggacagattggattttgggagttagtagtagagataatgaagacaaagaccacctgggaagactaagataaattttgatcggtaattgtattattcatcacctatgttcttaatttgcaaataaaaaaatggtcctattcatacctgagcattcatagttttcatgagtgaggcatattatgacttcatgggtctgatgtgttctttttgcaagcaggggtaaatggagacatttcaagcttgcctgctgcatattaggtgtgcctcagaaagagttcctctggtcagaaacctttcacagtctctcagcttcatgttctaattgttttagaattaagcttttaaagctcaaacatataattattacattccatttcaatcataatgactaaacctgctgatgtgattcttggccatcaggtctacctgttgatggcctgttagaatcacctgtgcagctttgaagaaatacagatgccagggcctcacttcctgggggctttgatccattcaatctatggcagggcctgggaatcagaatatttataaagtaccacaggggatgctgatacgtagccaggattgagaatcatggagctggaccacgcaggggtgaggtgggtgagttgctattgtcctacacttttattgctattcccaatgagatcatttttaaattattattattatactttaagttctggggtacatgtgcagaacgtacaggtttgttacataggtatacacgtgccatggtggtttgctgcacccatcaacccgtcatcgacattaggtaattctcctaatgctatccctcccctagccccccaccccctgacaggtcctggtgtgagatgttcccctccctgtgtccatgtgttctcattgttcaactcccacttatgagtgacaacatgcagtgtttggttttctgttcttgtgttagtttgctgagaatgatggtttccagcttcatgtccctgcaaaggacatgaactcatcctttttatggctgcataatattccatggtgtgtatatgccacattttctttatccagtctatcattgatgggcatttgggttggttccaagtctttgccattgtgaacagtcctgcaataaacgtatgtgtgcatatgtctttataatagaatgatttataatctttgggtatatacccagtaatgggattgctgggtcaaatggtatttctagttctagatccttgaggaattgccacactgtcttccacaatggctgaattaatttacactcccaccaacagtgtaaaagtgttcctatttctccacatcctctccagcatctgtttcttgactttttaatgactgccattctaactggcataagatgttatctcattgtggttttgatttgcatttctctaatgaccagtgatgatgagctttttttcacatgtttgttgggtgcataaatgtcttcttttgagaaatggctgtttatatccttcacccactttttgacggggttgtctttatcttgtaaatttgtctaagttctttgcagattctagatattagccctttgtcagatggatagattgcaaaattttctctcattcagtaggttgcctgttcactctgatgatagtttcttttgctgtgcagaagctctttagtttaattagatcccatttgtcaattttggcttttgttgccattgctttcagtgttttagtcatgaagtctttgcccatgcctatgtcctgaatggtattgcctaggttttcttctagggtttttatgattttaggtcttacatttaagtccttaatccatcttgagttaatttttgtataaggtgtaaggaaggggtccagtttcagttttctgcatatggctagccaattttcccatcaccatttattaaatagggaatattttccccatttcttgtttttgtcaggtttgtccaagatcagatgattgtagacgggtggtattatttctgaggcctctattctgttccattggtctatatatctgttgtgataccagtaccatgctgttttggttactgtagccttgtagtatagtttgaagtcaggtagcatgatgcctccagctttgttctttttgcttaggattgtcttggctatgcgggctctttttggttccgtatgaattttaaagtagttttttccaattctgtgaagaaagtcattggtagcttgatggggatagtattgaatctataaattactttgggcagtatggccattttcatgatattgattcttcctatccatgagcatggaatgtttttccgtgtgtttgtgccctctcttatttccttgagcagtggtttgtagctgtccctgaaaggtccttcacatcccttataagttgtattcctaggaattttattctctttgcagcaattgtgaatgggagttcactcatgatttggctctctgtctgttattggtgtataggaatgcttgtgacttttgcacattgattttgtatcctgagactttgctgaagttgcttatcagcttaaggagattttgggctgagacgacagggttttctaaatatacaatcatgtcatctgcaaacagacaatttaacttgctcttcttgctatttgaataacctttatttctttctcttgcctgactgacctggccagaatttccaatactatgttgaataggagtggcgagagaaggcatccttgtcttgtgctggttttcaaagggagtgcttccagtttttgcccattcagtatgatattggctgtgggtttgtcataaataactcttattattttgaaatacattctattgatacttagtttattgagagtttttagcacaaaggggtgttgaattttgtcaaaggtcttttctgcgtctattgagataatcatgtggtttttgtcattggttctgtttatgtgatggattacgtttattgacttgcgtaagttgaacctgccttacatcccagggatgaagctgactagatcatggtggataagctttctgatggactgccagattcggtttgccagtattttattgaggattttcacatcaatgttcctcagggatatttgcctgaaattttctttttttgttgtgtctctgccaggttttggtatcatgatgatgctggcctgataaaatgagttagggaggattccctctttttctattgtttggaatagtttcagaaagaatggtaccagcccctgtttgtacctctggtagaattcgactgtgaatccatctggtcctgggctttgtttttggttggtaggctcttaattactagctcaatttcagaacttgttattggtctattcagggattcaacttcttcctggtttagacttgggaaggtgtatgtgtccaggaatttatccatttcttctagattttctaatttatttgtgtagagttgtttatagtattctctgatggtagtttgtatttctgtgggatcagtggtgatatcccctttatcattttttattgcgtctatttgattcttctctctctttacactgtgagagtaaaaccgcctactcaagcctcagcaatggtggatgcccctacccccaccaagttccagtgttccagatcagcctcagactgttgtgctggcagcgagaatttcaagccagtggatcttagctcacagggctctgtggtgatgggaccccctgagccagaccactttgctccctggcttcaaccccctttccaggggagtgaatggttccgtcttgctgtctcgctggcattccaggtgccactggtgtgtgaaaaaaacctcctgcagctagctctgtgtctgcccaaatggccgcccagttttgtgcttgaaacccagggccctgatggcataggcaccagagggaatctcctggtctgcggattgcgaagaccatggggaaagcacagtatctgagccagagtgcatgcttcctcacgggacagtccctcacggcttcccttgggtagggcagggaattccccgacctcttgcccttctcaggtgaggcaacgccccaccctgctttggctcatcctctgtgggctgtacctactgtccaaccagtcccaatgagatgaactgggtacctcagttggagatggagaaatcacccaccttctgcgtcgatctcgctgagagctgcagaccagagctgttcgtattcgatcatcttaccagcaaattcaggaccatttttatttaacaagacaataaagaaaccatgctcaagctagcatttagccagaggcagagagtacccagcacatttagtgctggctgtttagaatacagaggacaatagacaactgattgaggtagtttctcgtgtcaaatcagtgtaatcttgagcaagttccttcccttccctgggcctctgcttcctgatcttcaaagcaggagagttggatgaaacactttctgtgtgtcttgcagtgttgacacttgtcattgctgtgactttactgtgaagacatctcattgtttagtggaggaagccaagtgccctcctgccaccccatggggaaacacagccaccagaaagaggagggagaggtggtgtctggggagatggaggagtctgactgcagagttagccctggggtgactataggattaacacgaggctctccagtaagggctcattaccccttgatgaaactcaaatgtcatcatgggcactctgttcttacaggatggtagctcttggaatctcagaagttggtagagtggatatctggctttggaaggagaaggtcctttctccttaggggagacagccatgcacatgatccgtagaacacggagggtccagagatctgagaactaaagtttatgctttgcaaactgtaacagtgtgataaatatgaattattatcaacatgattcttgctattattaaatcctcacactgcaatgttaactggttcatgtttcagccccagctcagccactagttggctgtgtgatctcagacaagccaagctccatctctgagatatagctgcttcatttgcaaagtaagaaggtagacgtgcatgatcagctgaagatgcttcctgcctcaatccagtaagtgtgatcaagatgttgaaattagtggttgaacaatcagtaatcagaagctcacctttcaaaaagaaaaaggccagctggaaaatgacataattaaaagaggaaaagaaaactctttctcaagaggctgctctttcacaaacagtcagcatgtctgtgatattccgtgtagcatattccgatgacagggaaacacagtggatgtgctgaaagatgagcagcaagtggtaagtggaggtgtttgaaatagaaaagtctattttaaaagacgactaataaagctggaggaggcggcccacactgaagcagtctgagccaacatcctgttgccaagactccagtccccgctgctgtgcccggggccctgggactgtccttggcacagcatgtgagccagtaggaaggagcagaggctagaagcaggggctgggtttctgtctgaggaaaggggcccatggagaggggccccagggaaggggctgcctgtggctttggcagaggagacccctgcccttcctgtgaccccagccagctccaggcatggtagggggatgggtacatttctctaggcgcatgcaggagctgcaccggtgctgggaagaagcaacaacacaacagttaagagcggagacctagagccagaccgagtttgaatcccggcttgtatcacttaatagctgtgagactgtaaacaagttacttaacctctctgtctgtcatcttttcttgtctataaaacttaataatattagctaatcatagggttgcagcaaggatgtaagttaattttgtaaaggatttgggacagggcaaacagtacactagagattgtgtgtattttatatacatataaaatatcttatgtttattatatataatatagctattatatattacatatgtaatacatatataatatagacattatatatatgtattatatatataatagagggatatatatgtatacatagatgcataaaatgtggcctatgagttgggcccacccgtttcttgggcagaggtccaaggctaatcagtgcccttggtcttcaagtaaataatgaagctctgaaagctaatctatgctaacaccctcaaggtcccggtaacccctctctggtctcctctgagcattaggccagatctgcaggaggagatgctcaggcagccccaagccacagcttaggactgaccagacttctccctgagctccaggcccatatacccaactgcccagtgaatgtttctactgggatatccacagacatctctactcatcatgctcccaaacctactcatgacccaattccttccagtgcagacctttccttgtttccagtctcagtgaatgacaatacctgtggggaaaagcaagagagatcagattgttactgtgtctgtgtagaaagaagtagacataggagactccattttgttctgtactaagaaaaattcttctgccttgagattctgttaatctataaccttacccccaaccctgtgctctctgaaacatgtgctctgtcaactcagagttaaatggattaagggcggtgcaagatgtgctttgttaaacagatgcttgaaggcagcatgctccttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtaaaagaggaaggaatgcctcttgcagttgagacaagaggaaggcatctgtctcctgcctgtccctgggcaatggaatgtctcggtataaaacccgattgtatgctccatctactgagatagggaaaaaccgccttagggctggaggtgggacctgcgggcagcaatactgctttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgacacatccccctctttgagaaacacccacagatgatcaataaatactaagggaactcagaggctggcgggatcctccatatgctgaacgctggttccccggttccccttatttctttctctatactttgtctctgtgtctttttcttttccaaatctctcgtcccaccttacgagaaacacccacaggtgtgtaggggcaacccacccctacaaataccatccttctaagagagtattgtaaaactttatttacaagatggtgttgcaatcctttagccctccctctccctgacccaatatctcatttctggacaagttgtatccatccttactgtgttcatctctgtatctccagtagtctgggatgtcattgattctcgccagtgtttgctagaaagttgaatgtatgaatgaatgaataaatgaagatggtgcctacacatcatcataataacaatcaaggatttatcgagtacatactgtcttccaggcaccattctaaatgcttggtatatgtgcattccacacatataagagcttgacatatccaagcctcattgtgacgatccctgcatatgtgttgaaagaacacaaagcatgcatgaggaagtcaggtcttggtgggtcctgggtagagcttctgggtagaactttcataatccctcaaagccaatggtgtttccttactttacaaagccttctcagagccaggttctactgagctgtgtccggcccagtacagtgcagtttctggaccgtttttctcccctgccgggaagatgcagaagctgccgcttcaccgagtcctctaatagcaaggccttattttctctgccaccctggggcccttgctcaccatgagcttacttctgtgcagctccacacaacacaccgtaaaaggaaaatggtaattagaagtaacgcttgagcaggggaacttgcgtggaaaaatgctttagttaaaagaagcagtaaagattcctttaaagtgttagacacacacacacccatctagctgttctccttttgaaaggaggagatgagaggacacacaaggtgtattgtgcatctgtaggcaccgcctccttagggcttgaggtcgggccagtcctctagggatcctgctgaagtggccaatgggattgagtttacatctcagtagcccaggaccaaaagtctagcccaaccagatggaatgtagcaggactacatccatagcagggtctctgtgtgtatccaaaacagctgcacagggacaggattgtggagacagaggatggcagcccctacaaggacatcccagctcctgcttccttttttcatagcatttattgtcacccaaagctatgtttttgcatgtttgtttattaccttatcctcaaccagattgggaagcccatggaggtaaggattttatcagtcaagttcacctctgtatgcatgccatgcacagagcagggcacatacataattggcgttttagaatatttcatgagggaagattctttgattgcaaactgcagaatcctgatgtcccaaatgttgcctggtgcatcataagcttctagaacacaagctttaagagagcagggtctttgcatgtagcattccagtagctgttctggagtgagggttagcacgcttttcctataaagggatagagagaaaagattttcagctttgtgggccaggtggtctcagccacaactactcaattctgctgctgtagtgtgaaaactgacagacaatatagaaaccaacaagtgggcatggtaatgtctcaataaaactttatttacaaaaacaggcagcaggccagatttgaagtagtcttccaacttctgctctagaatataaactccataaaataagggattttaaaaaaaatgtagatccataaccagcacttgcaacagtgcctagcacacaataagtatgcaataaaacatatgttgaatgaatgagtgaggggctaaaagtggttttagtcaacagcttgctgtgggtcagggtcattatgtgtgtagttatattggcctactgagctaaagacactctggaagcagatactggaagcctcctgtgttctgggctagttggatgacacctggaatatcattcccaaagctaagggtctagagtgcatgtagaggacagggcctgagatggggcagagacaggtgaccttgtgacatggagaatggtggaaggaaatggacagactgagcctagagaagagaagagtcagggaagagacagtttatatatttcaggactttcatgtggtagaacaatgagatctttctaagaaataagagggctatttttagaactttctgtaagttaggtagaccttggtgagagtgagctctcactctactgggagcgttcaaacagccatggggatgctgtggaagggattcacatattggaagggggcaggattagatactgttgggtcacttttgaccccaagagccattctcacatgcagcactgcagcacaacagtctgcaacactgtttcccaagcaacagatggtgactgccctccagacaaaaccagaatcccctgacttgtataggaggccccttagggttgtccctagccttctgcttcaatcgccctgttcccatctcctgttatctgtaccaccttcaacgaacacattttggcatttctcattcccctcttgtttctcctctcctggcctttacacatacgatgttgtattagtttaggtttctccaaaaggagaactgaggcaaagatccaagtgggtgtagtttaagagttgatcctaggaagcatggagagggagcaggaaactgggaaggaaaggcagctagtaaaagttacattagcaaacccacctttgctaatgctgtgctgactggagcttaacccactggggagtgtctgggagccagtgtatatcacatcacagagtcatcctcccctgaagagtgagagaactggggtatttatacatcaactcccatcagtcgttagttgaggaggtgtggggaggagggttgaatgttaattttctagcacctccaggtctgccacttacatgggcaaaagtgagctttggaaacaggagaaagccctgaggcaaagaactgcaggtgtggcagttggaggtgcagcactgatgtgattgagggtgaggggccaagagtagggcacccagccatgtgtgctgaaagctgccttctgcttggaactcccaccccactcttctgttttgattttgatcccacttcatggtcacattggctgctatgtaggaataaacagctcctggttcaagagttgtgatgagtaaagcattgattcactcctgctcaaggtcaaacgtgagtttggttaggcagttctcatcgctggtcctgggaaacagatcaggttcacttatttgtgcaaaggcaggacatatgtgtcctgctgtgatggacacatgtcttgataatacaagacagcatcgacacaggcctcattgaccatttcaccacctggtcccatccagtgccattgtaaaacataccttctacctactcaggaaccactcatttgggcccttagtgggagatggttcataacctccttcagacgtaattccagtgccagtcctcacagggtccagatcactacggctggtttagctcccaagcccttgtattcctcccttcctcctcactggctcccagcatgccttgtggctgactggcagaatatagagacaaggaaaagagacattccaccctttccatgtgcatcctttattcattcactcatgctgtaaatattgagtgcctactatgaacaaaccaggccctggccctgtcctcatggagttcacggtctagaggagaagacaaacatttaatcaaataaccaaacatatatgtaattacaaactattatgaagttggtttggagatttgcagactgctggcttcttgacatctggggaagaattcctaggcctttgcaaattcttctgtgtgggttcagggtggaaagcagtgtatggtagagaccaaagcagatgggtgagtgtgctgatcttgtggaggcttggtaattatagctggtgcattattaataaacattctgtctctgcttcctagttacgtacagttgcttgggccgaatgctgttaagcttgaaccacgagctctaaattgttcaccttgtcttcctgtttaatgaaaggttttaggaagtacagatctgttagcaggggagcacaattgtttttgaaatcaagagagcccaagaaatcttagggaagtgctggctgatgatgataatactggagtgtctgatgggcaggtggaggtcccactcagcttcgtaataggtgaagacagccagaggggtgaggaagaaagaagggtctgctgcttgccctttcccaggaagcccagttgaaaacctgagggatggagctgctacacttgtttcctaacatcatctgttttttttttcttgctgctgtgaattgctttctagttctcaagagcataatgcaatatcaaccattttgactagagctttgtccttgggagggagttttcacatgaacaggaggcagcagaaagccaggaaaaacagcattgacacgttaggtccattacaccccagggaaaactttcccacagcaaggtcactagaggcagcctctacacacaatgactcctgggcagaattctgcccttggatagatagggaatgaccttggcaaatgcagaagccatttggatccattttcagaccatcaaatttggcttgagagaagtagaattaaaaataaaaatcaattaacactcttagtgtcatttgaaaagtgaaaatttcatgggttttacattcagctgtgtgaccctggatttaaggcagcagtgacctggggtaagtttcttgacatctctgagcctgggatttctcataggtaaatgatattcattcaacaaacttttactctgggatataatgtctggggatgtgggaagctgtagttttaaggccaggtacaggcctagggatggaacaaaagagaggtgcatggggctctattccttggtgaaacatagaaagatggtgaaagaaatctctgttttgggtaggtcagacatcctgcaccgcatgaagcacatgtttgaaaacggccactacctaagagtgtcaccaccaagaaccatttaattactcaccttcaggcagcaatggggagggaagggagaagtccactcacatttcctgagtgcctcctgggtgtcaggaagcaccctataaacatgcatgtatcacattgagtctccatctactcagctgggaaggtgttacagttctccttttacagataagaaaatggaagctctgagaagtgagtcaacatccttgaggtcaacacagctaggagacagcagagctgaggttcaaatccagatttaactgcttccaaaattctcacatttttttccatcaaggagatatctaagctcctatctagatctccatccccacagacaccctgggttggttcggttttgggggatgagataggacaggcatagaagagtgcatgtgtgcaccctgcacccacataggtagttctggtaccttctctatccccttctggacaatctcagccaaatttatgacaacttctgcatgcaggtgacctccaaatttcagcctttagcaccaagctctctgttgagtgccacacccaaatatccaaatggctatttgacgtctgcagctggatgacctatgggtactccaaacccagagtgttcatgagtgtccatgcatgcccagattgattacaggcttcctctcctactcactggctcctcctccattattctctgactcaatggataaatctgctgaagttggtgctctttacagctccgtgatcagtcagcccaagatctttgctctaatttctcagtcatgtccttcctcaaatgattcttcctgccatcttccctaattggagcacagaccatctcatggagggactgtcgaagtattctctcccctagggactctctctgttctccaactcatactttaacctattgtcagtgtcttggtggaaggtgcaggaccttattaggtggacattgggagatggtcatgtgggctagatctttattactcaaagtgtggtctacaaactggtagcatcagcaacgcttgggaacttgttagaaatgcggaatctcagactccaccccagacctgagaaatcagaatctgcattttaatgggctatccaagtacttcatgtgccatattaacatttaaggagcaccaagataaagtgaacagcaggagcaaactgcaaaggtcaaaaagaattgagcattttcagtgaaatatgaagaaaattgtttgaccagaggggaggggagagtaaacaaaaatctgacagctggaactctatgcaaggccaagacattactctgtgcatgttaattccacaaagccactctaggaggtattgtaatccctgagaaactagaaggacttggaaggatggtcattatattcattcaaagatcagggaactgaggctaacaggtggtaaattatttgttcaactttccatagatagtaagtagtacggtcaggatctgacacagacttctgatctccagtgctccagttgcctcagtttaacagatatagcccatttccccatcaccgacctttgcagagctgtggttttccaacttaagtgtgcattaggattacctggagggctggttaaaacagatggcgggccccaccctcagggtttctgattcaggagctctcaagaagggctggagcatttccatttataacaagttctcaggtgatggtgatgctgctggtctggaggccacatcttgagaacctaacctgtgagactgacgtcatctacaggtaagcttgttggaagaatagctgcttatcaccatgtgtttccaaagactgagatggttattggctctcatagctcacttcattttttccttacaactattcaatgcagacaatatcacttcccatttacacaggctgcaactggtgctcagaaagattcagtgtatttttttgtggtaacacacttactagaaggcaggcccatacaagcccattaacaactctagccttgtagtgtacagtctcaagttgggaggtcattaaggagcctcctactctactttcagttaaaagatggggaaatgtaggcctggagagcaagtgagctgcctggagttccacagcaacataaggggattgccagctggggaaccctctcttctgaccccagggctagtcactggctcttccatcagctactatggaactctatggactttggctccccaaatattcaccaaggagcattgctcaggactttagacacttttcaaggccacgcatattggcttgacagaccatagcaacaagagccgacagttatcacgtacttactcggtgctggtcacttttcagttaagtgccttggattgacccacctgatccttgctgcaatgctatgggttgtcctttgctgtgctatgagatggatgcagaggtcagctgtgatctctgccctaggggaaactcaaagtctagagggggagacaggcaagctcacagaaatctcagtgtatttaaataacaataggctgtgcacagtggttcatgcctgtaatcctagcactttgagaggctgaggtaggaggattgcttgaggtcaggagtttaagaccagcctgggcaacatagtgagatcctgtctatacaaaataataataataatatcaaaacaatagtaacactttggtgaagatttgctacttgtcaagtcttcatttgggttaattgatttgatttttttatagccaactatgaagtaaagaagtattattaccatttttacagctgaggtaactcaagcttacagagtgagtgtgacttggaaatgccagaagtttcaaaggagctgagtgcaggtctttctgatgccagaactagcacttttaaccctcttattacaccacatgtatgtgaatgtgtgtgtccacactgcacaagggggagcatcacccttggcttatgaaaaaaatgaaggcaaagggcaggaaagatatttatccaggtagagattatggtttttcaagcacattgctgcaaaagaagccaaggccagtcttcagtgggccacactctgatgtgctaattataagtgaactcttagctgttcattaaagatagatctttttctgttcctttatttccctgcaagcagtcttgacagcattgcttttaaaaatattctgtaattcagagcgttacacttcactaatttaccccctgcatctcttcattacatcacaggcaccccttgtcttctcatcttcccctatgatccctgagtggggttatccctatcctcagtcagtgaacatatttagctgaaccctaaatcccaaggattaaaggcaattaaatgagataatgcatatggcgtcactttaaaaccataaagggccgcacagatgcgaagggttattattatgagccttccctgttaatgagtattaatgagctaaggctgcagattcctaatgttacagagccctaatattaaccatatggaagcctaattttcaaagagaattagaattaactggaagaagaagctgcaaaaaattttgaattcaattccctctcctaattcttggtatcttgaccgcaatctgcatgaagctaaacggttatgtgatgacatactggtttatctttattcttagctaattgctttaggatacctgcccccatattattctgcattttcatggttctcttgatagggacctagatttttttttctgcgaatgatgtaacatgtctaatttgagctttagggtatatggatactggaattgagagggcacatcagaatccaaaatatttcaagttccttaaagtcaaggagtgattggaaacacctgcagccaggctgacttcgctgagttgtgacttgagatattccatgtaaagttcttgcacagagcttggcacaaaaaaatgtaacattattgtccttatcatttttgagtctctgacagatacatagacagggttttagatcacaaagccttgaagggcagggtacacatttaggtattattttctagactgtggggagccactgaagattcttggggcggggatgttgagcacagttttgtgtttttggggcttttaactctagcagctggtataggagggaatataaccactggtgtcaggaaatcaggtaggaaactgtttcaaaaatctatgagagttgataggggcctgaactgggcaaggccaatgggctggggaagaaagtttacacacaagagatttttaaaaattagcatagatagaacttggtgattgatcagctatgggctatgacaaagagtgagactcaaaaagtctaggtgattttttaggtttaagttactgggtgaaggaagccaaccaggatgaatacaggagaaagagctgctttgggggtgaaaggctgagttatataagtagagccaaagccttcattctagtggttggcatggctgttgagttccaggactatttgggaacagaacatgccaagtaaaatgaaagtataaaatcagaaggatcttgagtgatctcttaatccagtcccattattttataattgaggaaactgaggctcagagaggggaagtgactttttgaaaaccacacatcctttattaaggaaccaggtctggtttctgagtccctcaccacctcagatcagagcttcttcctatcccacccaaaatgtaaagacagaatctgcttcaggctacattgttttccagaaagaaatgagactttgccaaactctgggggaatttttcaagctttgaatatatcttgtttccttttaaatgagtcctagtttgtagacatatcagtgcctgaacatagacacccacagaatcacccacaactatgattgaggggaggaggtgtcgagcagacagcatgggtgccttgggagagggaaagggaggtgggaatgtgggaaaattgtgctctgggctccctgagaggtggtgtgaagagggcagcactaacagatagggaataaggcaggttagaggcactggtgctgggcgcgctgagggaaggggaccagggatgccatgaaggccaagacctaggggttagacccagccaggagaaaagaaaggctttttcttgaagagctcaaaatatctgccttgggcaaacaagatggaaactcacaacctcacaagctcttcaatcacccatctctgggggagtcaatgccataatgcacccatgccaacctctgtgcttgaacatctccagtcacaagggaacgcacttttaagttctatccccttagacctctagtaggtaaaatccattctcccactgatgagtggagagagattcctgagaatgagcagaaatctctccttacaatgtttctctgtggctcttagtttttgttctttttcccctgacatttacacctgtatcactaggcagattacatctttctacaagtcaccaacaatagtttgggacagaataaatccaagaacaaagctcaagctccatggcacactatcagggtacagaatttgccaagcacattctgcaaagtttgcaaaatgaagatggggcctgattggagaagctggggaatgaatccatgtgccccttgcatggcctgctgttccaacctatgatggacaggcaaccctcctcaggaactgcaatgttcttgcccagggtattagaatagggggcaagagagagattcaccccaccaagttacttgctcaaagtgccatggagctgtcagcctagggagggaacagccactgccttgttctgccctaagatgccacagggtgtgtgcctaactttgacacacacacgggttgcctgcccctactgtgtatcattggggatctctctaccagatggaccctaatcctttgggaatagctatgtagccaattgatactttgctaattgctcttttattaaaaccatatttctgcatattatccatctaacatatatatctctccatatagatttatattgattacctattttctccaaaagccaggagtggtggtcccttttgtgcagcatggagacacacattcacatgcaggtggcatgatgtaatgagagggttaaaagtaccagctctagagtcagaaagacctgcattcagcttctttgaaaccccttgcatttgtaaatcaccagctctctaagcctgagttttctcattgtaaaaatggtaacaacactcctttacttcatagtgcggctgtgaaaaatcaaatgatccaaatgaaggcctgacaagtagcaaacactcatcaaagctttactgttgtttttattatatataaatacactgagatttctgtgagcttgcctgtctccccctttagactttgagtttcctgaagggaagggaccatagctgacctctgcatccatctcctagcacagcaaaggacaaccctgtagcattgtagcaaggattagatgggtgagtacaaggcacatgattgagcagcgacctgcatggagtacgtatgtgacaattgttggctcttgttgctatggtctgctaagccaatatgcatggccttgaaaagtggtgtctaaagtcctgagtattgctccttggtgaacatcgggggagcccagggcccagggagggtccatagtagctgatagaagagccaaggactggctctggggtcaggagaaaaggttttccagccggctccttccccaccctgctgagtagcattagcagaacccaaaagagacctataattttaggagagggccaagtggtaggagctgtggccttgggtaggggaatgcagccgtggcttactctggtttagcaggacttaagaaaataaatgtcttggctttcctctacgtccactcttctatctcctccttgtgttttttattggctaagcctagctgaaaccagagagcaagagaggttggtgatagagccatagaagtcattctcttgggattcataggagagtagggatgggcagggtggggcaagggtgggtgaatgagaatgtccagccaagacccaggcactggcctcctctcatgcaagcagatctccttgatcttctaaaccaagccacagaaccctatcatattttgaacaatttttcagtcccagttccttggggctttagcttccctatccattttacccatcagtgtcacactcataccagccagcccttggtgatgtgtcaattttccatcttcacctgacttttcaaaactcaagtccctggggagatctctatgtgtaggctccacctctcttcctggagccacaaatgctcagaactggggctttgagagctgccctgagtcgtcatctctgtcacatctgatgacagtttttattaggactttctgaaagctgctttcagtttcaggatgtgtgtccaaccttttctcagccattaggaaccctgagctgatacagtcactttccctcaaggcatctgtcacttacagtttgccaaccagttcctccttgctggtcatcattagggccggagaagcaggtcccactgggagttgaggtagtgagggagagaagccaagaactttttagattcatgtctttagtcaaatgagacttggaatagccatgtggcaggttaagccttccatcacttttagagttggtcagtcccaggcccctaactatgcccccttgcagtccctaaagacctgtcttaatttcatcccagggcccagtacctactctcagactctctggtagctattgtggcctgctccctcatctgcccaaatgcaaggaactagaaatagtgcctcattgcagcccctcgtcattgtatgatcccaacctactccaaatacccaccatctatctacccaattaccactgtgcccttctcaatcttcttcagatgaactgatcccttgggtggtagacagaatagtaatcacctttcccctcaaaatgttcatgactgaatccccagaatctctgaacatatcatcttatatggcaaaaaagactttgcagatgtgattaaattaaggttcctgagatgcgaagattatcctggattatccatgtgggagtcaatgtaatgacaagggtcttcataagagggaggcaggggtcagatttaaagaaggtgatgtgatagaagcagaggatggagtgctgtcatttctggaaggggccatgagccaaggaatgtgggcatccctagaaactggaaaaggcaaggaaagtattctccctggagcctccagaaggagcagagcccagctgacccctttattttagcccagtaagacctgttttcagctttctgatttatgcaactgtaggagaataaatttatgttattttaagccattaagcttgtggtaatttgttacagcagcaataggaaatgaatacaacctgctactcaagaagtgtggtctacagcaggggtccccaacccctgggccatggaccaataccagtctgtggcctgttaggaagtaggccacaccagcaggaggtgagtggcaggccagcgagcattactgcctgagctctgcctcctgtcagatcagcagtggcattagattctcatagaagtgagaaccctattgtgaactgctaaagcgagagatctaggttgtgcactccttacaagaatctaatgcctggccgggtacagtggctcacacctgtaatcttagcactttgggaggccgaggcgggtggatcacgaggtcaggagttcaagaccagcctggccagcacagtgaaaccctgtctctactaaaaatacaaaaattagccgggcatggtggcgcacgcctatagtcccagctacatgggaggctgaggcaggagaatcacttgaacccaggaggagaggttgtggtgagccgagatcatgccactgtactccagcctgggcaagagagcgagactcagtctcaaaacaaaacaacaccaaaaccaaaaaaaaaaaaaaggatttaatgcctgatgatgtcactgtttcccatcacttccagatgggaccagctagttttaggaaaacaagctcagggctccaactgattctactttatggtaagttgtatgattatttcattatatattacagtgtaataaaaataaagtgcacactaaatgtagtgcacttgaatcatcctgaaaccatccccctgactgtggaaaaattttcacaaaactggtccttggtgctaaaaaggttggggacggctggtctgtggcatcaccattacctagtagcttcttagaaatgaagaaccttcatcctcaccctggacctgctcacccaggatctgtagtttaataccatatccaggtgattccaatgcatattaattggtatgcttttgtcttccccaggacccctacctgcagatatttagctccaatttgaaccaattcaaattagaaaggatccagtccaatgaaagaaatagatttgttatgagaagaaaaaatgaccaccccctctaccttttttttccctcacctcacttttatctaagtatagctaataaaggaccagatttttaagaattatttttaaaaatttacttatgtctttaatgccttattattttttcctggtgctgaggttagggtagaagtaaattttagattctgaagctgttaccataagccaatcgttgtcctatccccatcacatttgttggggactccctgcattactggccctgaataaccactgagtgagaggtaggggtatttcacaggggtgataaagtaggatgtgtctcaatggtggaaattcgatttgcacgctgctcaaccagaatcagcataaactctgagccttgctctggccatgacctgggtaggtagatagatccagatttatcaatggctctgaaacaaagggaaaaccccacacactatgggaggccagcactgaccaccagatgaacaggaagccttgatgtatatgctctcataatatatccttctgtgtgaaatactacaaatttctcccaagacaagaagttgttacattcattttttggcaagtacaagaggcagtcatcccacaaagtctaggaaaggggatatatcttttggattgcaacccctcaaatggactcctcaagtgatttggggtactcttcctgctgccccattaatggggacatctggttctagacccagcccctcctaatttgatttccatttgctgttgagcttgaaactcctattctggaattgccagaatatcctgaattcttcacaaaagtcttcttgagggggaagcattaatagagctccgtagagagccatgagtccttctctccctaaggtcttgatacaagagagtcttgttaactgtcagccagtatcacactggttacctcctggagcctctgtgggaaagagcatctcaatgctttgagggagactttgggttgaaataggtttccaggataattaacaccaattgagaacacaggcaaaacttcttgtcttccaaatttgaagcccacattagctaattagttctaattagaggctgacagttccatgtggcacagtgagcatgtaataggcagatgtttttgtatgtgtcttgacaaattaatgaagatgggttgggggatttctttacaggcccatgggccagctaggtgctagaacatatcttttcttgggaaagggttttggttttggggaagcttacgtggtgcccccagaggaagcccatctattgataataatgcctttatgtattccagaaacacatagtgagcacctacattggcgaagaattggtcgaagtagtgaaggagacactactttcactatgtggaatcccaaagtctagttgggaggcaaaaataaaccgaaaggatccagtggcatcctagccaaagcagtaagataagaaaaatacaaaaggagatctaaatattaggaagatccaaaatgccacagtttgtatgattccatttatatgacatcttggaaaaggcaaaattatagtaatggaggacagatcagggcttgccggggtttggggatgggaagaggtattgactaaaaaagggcagcacaaaggaattgtttggaattgttctgcatccttattgtggtggtggttatacaaatctgtgtatgtgttgaaactcgtagaaccgtatgccagttttcctgcatgttattttaaaaaatgaaagaagaaaaaatggattacagcttatgtatggaccaacatctatgcatctcagtgtcgaataaaacccacaaatttattttacattgtttgaattttcagacaattttgaaaagcatgtctttaaaaagtaatccttagctcagtttgtatacatacgtatttttataacatgaagatcttttgcattaatgcataaactagttgaaataaacaaggaaagaattgtaaactttaactcatataaaaataaattaacataaaagtgttaaatttgggtttataggagatatggagagaatcctcatggcatttgagactctaattctagtttttcctgagcctttgggtttagtgaggtgcctcaatatcctcatgataaatttaccatacttgtttagcctaaaaaataccatgatttataagtgacatgtctgtctatataaaaaattcaagagactcagctaaaagtagttgatgctaataggagtgttcagtaaggtagtgggatgtaagatgaacatgaagaaaaatagcatttccattgattagaaatatgtaattagaaaatacatataaaaggatcccatttataatagcagcaataaaaacaatataaaactctgggtaattaactaaaaatagtccagatttatatgaaagcaaatacaatactttactgaaagccatgaagaatggctggaatcaatgaagagacatatcatggtcctggattggaagagtcaatcaaaagtgtaaagatgtcagtccttcccaaacttatgagtaagctcaaagcaatctcagtgaaaatttgcgtgagcaaaagcataggggacgtgaaagctgattcctcagaacgtaagcaatctaggcggactgactgaagcattggtggtgagagtatgaggtgttctcctgggaccagactatgaagagcctaggctgctagactgaggaccatgcccttcatctgacagcccataagaaactctcgaagatttcagttcaggaactaataagatcagaactgtgtgtgagaaatagatcttggctgatgtgtaggattgaaggaaagggtgagacccaaggcagggaccctgaccaggaggctgctaactggaatggtctgaaatgactgccatgctgcctgatccaaaggagtttcccagtgaatattagcactctcccctcccctacaccccactcccctgatcttcctttctctccccttccctcctcctctgaagcaaaaacccagtggagaaatgaactaacagagttgccctgagagggggtgagatattttctgccaatctggggtcattggggagggttatcttaaggaagatgccaaggtttggaatctggaagcctgggtggacaatgatgatgataaatgctactttaaatatttatttatttatttatttatttatttatttatttatttaagacagagtctcactctgttacccaggctggagtgcaatggcacaatctcggctcactgcaacctctgccttctgagttcaagtgatcctcctgcctcagcctccccagtagctgggattacaggcacacaccaccacaccaggctagttttttttttaatttttagtagagacggggtttcaccatgttggtcaggctggttttgaacttctgatctcaactgatccacttgcctcagcctcccaaagtgctgggattgcaggcgtgagccaccgcgcccagcctaaatgctactttttattgagcatccactatccgtaagacaggaactagcactatcccattttttaatttttaaaaaaaatttttaatatattttttatttttatttatttatttattttttaaagaggaaacaaagaagttaagtgttcagaaagctgaggcaggacctaacctggtcactggtcatatcaccgacatcccagcaccgggtacaaagagttcagcaaatgtttgctgttcaccagatgttgcttctctagaaatgtccttgctgtgggtttggctgatgccttatctttatgagtaaatcccttttcctttcataaataagtcaccattttgcaaggaggggaagagaagcgttgaacaggaagggtggggaggtaggagcagaaaagaaggggctgagtaatggaactcgaggtgtttttataaattaggaaccacccagcttgccactgacccaggcatctttatcaatttgctcctccaggccatgccagcctagcacaataaagcttcctgtccatttcaggcttaatcacacagaatgtaaatccctcagcagagaggcagctgcgagggatggggcacaatccgcagggctgttcattttcatcttctggcacgtaatgaaatcaggaatgcatgtctgctcaccagggcttctttgctccaaattgttaagtaagcatccctgctttagcctcattagactcccaaggccgctgatgaagggggatggaagccagcatttattgaatgattctggtgtgctagatactttctacgtgattcactcctctaaaaagccccgtgacatgggcactattatccttattttacagctaaggaaactgagctcagaaaggtcagcccaagatcatggacggataaaatgagtagggaatcatgaagcgacatatctgtgcaatttcaaatcctataccccaagcctttttttttttttttgcagttattagatataaaataacttttatataattttggggggatttctgggagaagtttgagggaactgaaggttattacttttcataattcattttggttgtgtcaatttaattaacattcactgagactctgatccactgtggctctgatttttaggcataacttgtgtgtccatcattcatgctaaatagagatagtagtcctgtcctctgcttctgctcctttttcttcttcttagtttttagacatcctggtttgtgttctagttcataatatctgccctaagatcttcattcttattttgaaaactacatttagttcctcttctaataccccttgtcctgcctcatccgattcttattttgccccttgtactattcagggacacctgcggctccaggtcagagatgcacctgctagtcctgcctctacaggacccaacccatcagttcctagcttgtccttctggtgagaattgagcacactatactgtggacataaagacaagtaagttgtcattcatgccctggatgaacatggaacctaactgggaggtaaatacacacctgaataattaaaaaataagctataattgaacaaatgctagagtaaagtgcatacagaaattttaggaagttggtgggtaggggagtaaataataatgtgttgttccttaagtcataataaatttcaaaatatctgttaacatctatttcctctattcccattactatgtgaattcttagttcctgacaaatgaattagttgaaacagtaacattattttggtatttttatttattgtttattcagtctgggtcaacatcatagaatgctgaatcagcaggcaattccacaataatctgcttgagtacaagaatttgaatatgatatgttgtagggatagcaggataccaatatggggagtgggtttgggtagccccccatacccttaagtgaataaagggctaggctggaaagttatgaatgtggaatggatggtttgagaactccagacgtggggcaggtcaacactgacctcttaggaggaaggagtttagatgggataacattttgacattccctttggacagggaccctatggattaagtgggaaagctagagagggagaaggaagtggttgttcagataacataggtgggacttccagattcaggtggcatctggctgtggcacttgggttcccttttctcctcacccgtggcacttctcatgaagacacagaaaccactactactttttggtaacatggattctgggccttgggtggagtttttacttagtaaagcaaggatgatactcttgggcaaaagaacagaaaaatacatgataggagattttcagttattactcctatctacttcctgccttaaaggcagtgtctccactgaacaaaaggagagaaacccgcacttactacacagaagctgtttctgaggccatttaacctccagcactccctattatcacttctattgatttaccatttgtgggactaatttaaactttctagaaattaaaaaagcaggaagggatcgtggcagatgaaaacaggatatggatctttgcatatgtgtcttagtctgtttgtgctgctaaaacaaaatgccatagactaggtaatttataaggaagataaatggattttttcatggttctgaggatctggaagtctaatatcaaggcgctaacatctggtgtctggtgacggctgctctctgcttccaggatggctccttcttgctgcatcttccagatgggatggacactgtgtcctctcatggcagaagagtggaagagaaaacacccactccctcaagcccttttaaaatgccgtaatcccatgcatgaaggttttgctttcatgacttaatcaccttttaaaggccccacctgttaacactatcatttgggtgattaagtttcaacatatgaattttggggtgcacattcaggccataccaataccagactgtgaaatcaacgaaattgactgtgaaatctatgaaagagtagagctagagagacctgtgagacagttatatgctggtgaatgtaaatgtccatgcattgcttttcctaaagcagagacggctgcatacaattatcccagaatattccctccacatgttccgaagtcagcccattctggtctagaatacacatgagaataaggactgtaccactaggaatttggaatctgtgcatattaatcagccctcagcttaaggtctagatgtggattctaattatagtcatgtagttaataacaaggaccaaagaagatccatccaaactatgtactggcaacatgcctgaccagctttctcctttatcaagcatgaataataggaaaaacaaaacaagagaccttgaagatttttctgagacataaaaaggagaatactagattcagaagaaaaatgtcttgaaaaaatataaaatagttaataaaggcatttactaggatgcgtctttttgtgttctcagtaaatttgaacgctgagatacaagaaacgacagatgacatagtaagattaaaagagttgctaagatgcaagcagaaattgagataaagattgtaaatacctgtaaaatccaatagcttaataaaacttgtattgggattagaagcagtaaagaaaataaataatattgcagaaaatggagttggtgttaaggaagatgcagttaagaagatctcctggaatgtagagaaaaagcccagggaaagaaggtagttatcaatggggaggatatatggaggacagagaatggaaattctgggctgtagggacaaaagatggaagcagtgtcactgcgcccaggggcagggatcaccaagtagaaactggaaaaagagggagccttgtccagcccaagttggagtcacagaagggatgcagtcaaggcaaggaagagggggaaatacccttcttcttgctttccacactgcaatcttctgccagtctgtatctctggccaaacctatcctgaagggagcggatgagggaacctggaaaatgcagcctgtatgggtcagccctactgtgataccaaataagcaacggaaagggcagggatgggcatgagggcaaaaacaggtgaaggactggtctatacaacttagaagacactttttacaacaaaaactgcctgagtcaaaagttgatttgactgacacaaattaaatgtatcagttaaatacgtgaaggccaaacatgacagtaaatggattaaattcctccattaaaagaagatctgtcttagatttggtttagaatccaccaaagccaattatagctatttgtcaaagcttcacctaaaagaggcaaaaaaaaaaaaatgctaaaaataaaaactgagactaggagtgacaatattaacatcagtaaaaaagtatagtacaaggtaaatataattattagaagtcattttatgccaatgaaagaaaattcacatgaatgctatgatcctaatttccatttatctcagtgattctcaactaagttggtaaaagatgccccaaagatcatatcagagtctaagaagtcattttataaaaactcacatacacacatattctgatattcagcgggagggggcaagtaatcccatttccactgacccagaattactactgatgggcatacattgcagccttcagatgttgtggcaaacaaccaaccaaccaaccaaaaaaaccctaaacaaacccaaaacaaaacaaaacaaaaaaccaaaaaaccatcatgtagcctttggtttaaaataaatgtatgattagtaatattgactttgatttaatagatttggattaaattttgtgttctgaaaatggcaagaaaattttcattgtttttatgcaataaaacatggaacatttatcacaatctatactagtttataaagaaaattgatgatcaagatattggaaatgattctggataaaatctctgataagaatgaaataaaattaaaattagtttaattttataaagtgtcaatgaaaaattccaaacatcagttggctgttaacatgtggctttatttctggattttctatgctgtcccattggtttatgtgtccagctttataccaataccatgctgttttggttattataattacgtttttgaatgctgttggatttgattggctaatgttctgttgaggatttttgcatctctgtgcattagggatactggcctgtagtttttctcttttacatgtgtgtccttatctggttttactatgagggtaatgctggccttgtagaatgaattagggagaattctctcctcttagatttttgggagtaatttcagaaggattggtattagcttatctttgtaagttttgtagaattcagctgtgaatgcatctggtcctgggcttttctctgttgggagagtttttattactgattcaaactcactactcatttttggccaatttaagttttctatttcttcctgattcaatcttggttggttgtgtgtttccaggaatttatccatttcctctaggtttttcagtttgttagcatatagttgttcataatcatcttttgtttttctgtagcatcagttgtaatgtctcctttttcatttctgattttgttgatttaagtcttcccttttcttgtttagtctggctagtggtttattgactttgtttatcttttcaaagaattgacttttttcttttattgacttttgtatttttttagtctctatttcatttagttcattctaatctttactatttttctgctaatttggggttttgttgttttttccttttttagtttctttaggtacattgttagactgttaatttataatatttccacattttgatgtaggcatttattgatataaacttccctcttagcactgcttttgctatatcccacaggttttggttgttgtattcccattttaatttgtttcaagaaatttttttattttcatcttaatttctttgttgatgtaatagtcattcaggagcattttttaaatgaatttgtatagtttccagagttcctcctggtattgatttatttgttttattctattgtggtctaagaagatacttaatataattttgatttttaaaatttgttgagacttgctttgtagcttaacatatggtctatcctggagaatattctatgtgctgatgaaaaaatgcatattctgtggttgtatagaacgatctgtaaatgttaggcccatttggcctaaagtccagtttaaatccaatgttctttgttgattttatgtctaggtgacctgctcaatgctgagagtggaatgttgaagttccccaccactactgcattgcatctatctctctctttggacctagtaatatttgctttatgaatctggatgctctagtattgagtgcatatatatttagaattgttagatcctcttgctgggttgatctttttatctttatgtaataatgttctttgtgtgtgtgtgtgtgtgtgtgtgtgtgtgtgttttgtttttttttgttttgtttttttgtttttttttttttactgtttttgagttgaagtctgttttatgtgatagaagtacaactattcctgctcatttttggtttccatctgcatggaatatctttttccatctttttacttccagtctctgtgtctttactaataatttgagtttcttgtaagaagcaaatagttcgatcacatttttaaaagactctattcagctattctctctttttttcattttataaacacttggttttattgcacagaagaagttgaaagtggactccagtggaaagtgcgcactggcataattcagtggccagtgcccagccccacctgggcagctcttctagaatagagagctctgggcaagggcttgaccactcctttggaaaacagaaggcatgtagaaatagtttaagacatgtcaagcataatgtgtttgtaactgctcattcattattgtggtcatctgtcagttgcacatggaggaaataaatgcacttatttggaaaggagggaggcagttttttatagtcaagagtttacgtgtggcattcagcatgtaccacattcagctacataagctttcataacaattgtccatcgcttggggagggtgtgggggcagggggctgggagtgccctctcttgctaacatattgctaacagaaattcctgtttgaagaagaaggccccatcatctaagcagtttcttcttacattaagagagaaaaagtgaaaattgcattactccgatccttgagctctgggccccttctgagtttctttggctgctccagacattcctttctccgtgccttacttccccttggcagccttgtcttctgtggctttctctggaggcctgctgtctttttggtctgtgctggaggatttttcagccttttctgctttatgtttgcttgggtcccttgagagggtcttgtcatcctccttggttttggcctctgtcttgggtttctcctcaggcttcttggcctcggtggccttctcctccttggtgtcttttttctctggtgctgctgctgcctcctccttctctgctggtttggtaggtcccttggctttggcatcatctggttccttcttggccacctgtcatctctttgggtttagcgtcttccttcacctccacattggcaggagcctccttctctggggtggctgcttttttcttatctttagtctcttccttcttggcttcaactttggattctttgggcttttcgagcccaaacttgacttcagctgaagattttgcctcttccttctcagaggacttcgcttcctcctttgttggggacttggccttttcaggccttttcaggggacttgacctcagctggagactttgcttcttccttcactggggacttggcctcagctggtgactttgcttcttccttcactggggacttggccttctctggagacttggcctcagctggtgattttgccttttcctttgctggggacttggccttctcggggaacttgacctcggctggggattttgcttcctctttctctggggacttggcctcagctggtgactttgcctcttcattcactggggacttggcttccttttctggggatgtggcctcttctgttgggggagactttgcttcttctcccccttctgccccctcctcttcaccctcttcttcctccttgccctcctcctctctggcctctttctcctcttcttcagtcacttcttcagtcacttgggtctcctccatctgttcccccacaatcacagtttctctgacttctctaccactttgatcttctcttcacttttgacctttatgtgagtggacacggagggaattttggggagtccttctggaagcgagaaaggaattgggccgaagctagtccgacactcttcgccttccaggagttttctgtaagcggctatctctatatccaaagccatctcgacattaagcaggtcccagtattctcgcagctgggctatcatctcccacttggtggtcctcagctcggcatccagttgctgaatgacttcctcgtaggaggcaatgttggcctgatgacggtcctccagctcagagcgctgcctctccagtgagcccttggtgcttttcagtgcctccagctctgtggtcctggcctgcagctgacgccggtactcagttatctcctcctacgctgagcacatggcatctatgttcaccttcgctgcctctaacgtcagtccagccttactcagaaccactcctcggactgcagcgtgctctgcaccgcatggccttcaagctgcacgccgcgccgatctcgctcagcgccgatgtcacttcgcccttgagagcgttgcgcaactcagcctgcacctgcgcggcgccgcagccctgggtctggccgagcagctcgaccacctgctcctcctggtagtggcgcgacaggtagccgcactcctcctgcagcgcttgcacctgcttctgcagttccacgcgcgccgcctcggcctcctgcgtgcagcgcgtgagtgcgcgggctgccgcctcggcctcctcgcgctgccagagctcgttgtcgaggcgctggcacacgtgcgcgatgtcctcgagcaggtgctcctgttccaggcgcagctgcccaggcgcagcatcgcaccgcgcgtctcacggacctcgcggcccgcctgctgctgctgcagggccgctgcctcgccctccaggctgcggttgtgcacctccagctgccgctccttgtcgatgtagcccgcaaagcggtccgtcggcgcctgcagctgctcctcctcactgctcgttgtagcagccgccaccacgcatccctctggctggttgctcagcgtgtccagcgagtcggtgctcgaggcggcggctgggcgaggcggacacggagctcacggacgtccacgtccacgagtggaagccgctggaggagccagcggccgagcgcgtcccgcctgtgccgctctttggggccagagcgtagtggaggctgccaccgccgtgcaacggcaggaacagggcgcccagcaacgcgtccgcgcttcggaagctcatcatggctggagcaggtgcgcggggccgggccgggacggggcgggacacactgcctctctatcttttaagtggagaatttaatccgtttacatccaaagttattgatatgtcaggctttgttcctgtcatattgttaattgctttttggttcttttatatgttgtttgttcttttctttctcttttattgtttgatgggtttctgtagtggtaccacttgagttttttctttctccattttgtaataacttttccagtgaattttatactttcatgtattttcatgatggtaaatgttgttttttcatttccatttttaggactctcttgagcatttcttgtaggaccagtctagtgctaatgaattccttcagcatttggttgtctgagaaaaactttatttctccttcatttacggaggataattttgccgaatgttgtattcttgtttgacatttttttttcttttagcagtttgcatatatcatcttattatcttctggtctgtacgatttctgctgagaaatctgttagtgtgttgaagtttcctttataggtgatgaaatgcttttctcttgtttttaggattcattctttttctttgacttaagacggtttgactataatacgccatggagaagaccttttgtgttgtattttcctgggaattgctggaagattgagcctcttgtatctaaatgtttaaatatcttgctagacttgggaagtttttgtctattatttaattaaataggttttccaattctttctttctctcttcacccttgggaatactgacaattcaaatatttaataacttcgtgttgtcccaaatgtcataaaggctttgcttattgtttttactcttttttttcctttatttttgtctgactagattatcttaaaagacctatattcgagttctgacattctttcttctgcttgatctagtctattgttggagcattcaaatgtattttgtatttgcatcaataaattcttcagttccagaatttatatttagttattttaagaagtatctatctctttggtaaatttcttatgtttattttgaattgcttttcttatttccttgaattgtttttcagaattctcttgtatcacattgagcttctttaaaatcaatattttgaattctctatatggaattttaaatttctttttgattaagatctattgctggataattattgtgctcctatggaggtgtcatatttccctgcatttttatgttttctgtgtccttacaatcgatatctgcacatctggtgtaacagtcattttttttttttctatttttgatttacttttgtagggagaactttttcctgaagctctatgtatggtgttgagtgggtaggacacattactttgattctgggtgcatacagtagtgtagtctctgcacgatttctttgtctgtagacagtgttagtggaatctgtgatttcctcattgggttacattgtggttattagtgaaggttgtggtaaagttgtgatggagactgagatggcaattgggtcagtcttcaggccacagtcatggcagcagtgagctgagtctgcctctgtgtcccatgatggtgtacactggcacctgtgttggcagttactggtgggctgattctttggcctccaggtggcttacttgaatatcagtagtggcagcagtggatcagatgggtgagtgggttcctgggcccctgggaagctggtgtggcatgggcgatgacaatagcagtactggagcaattttctggggcccaagtggtgtgcatattgatgttggcagtgcttgtaaatggctaggttgaacagtcttcagacccacatgttatgcttgcaggtaagtgccagctaaggtggtagtggctgggagtttagtctcaatttcaggcccatggaaggagtggtcaggtgcccgaggtggtggattaggttgggcaatcacctggactgtgtgctctgtgtcgagagggagaatggcatagtcaggatggatgggcctgtgcttgccactggtgagagagggcactaggcactgtgagtgagggcatggcaatcctttggctccaggtggagtgttccaatgaaggaagtagcagttgcactgaggatatcccactggagaagatggggccagcttcagtggccacagtctgggccagcaggtggacaatacatatccctgcttcatcctagttctgatggggctcgccccacatccctggcagtgttagcgtgtgcctagcttgcactctagccctggctgcaggaggccctgcccagatcgtgaccaagtcccagcagcaactcacacttcacttgtgtcccagtctcaagtcccagcagtacttccttcctggcactggcaaactgcagcctgcacattgctcacttctcagctcgggctgtgggagtactcccagctcatgctgcagtctcagcagtgacaaccccattttcctgagtgcctcagtcccagtgctgctgggccccaggacagtgtgcagaagctaagtttgaaaatgatgacttgctatagtttcttaggtctcagaagagtgtgggactcagtgtgagctccctcgccccacagcaattccatccaatcatctcccagcagcttcttgtgtcagtttcagagattgggagggtggaggttctcttacgtgaccaggattgcatgattgcatggtggggctgtgtgttgctggaagtctctcactcactcttccccacattgggaagttactcccggctcccagccaatcctggccaagcgggctgccttgctttcttctccttcctcacttttggtgttttctgtcacttctctcttgaattccagtgttctgtcttggataatgtattcaaagtgtgactgtgtatacactatttttgttcccctaagtggacaaggaaagcgtgaaattcttctcatcagccatcttgaagtctttcctctgtaagttttagtatttccaatttaaattagagaataaaaggaatgaattattaaagaagttcaaagataactcagatacattagaagggaagaaatagtaaagataaaatcagaaattaattataaagcaaaaaataaaattgataagtaaacccaagagctggattttgaaaatgacagtataataaatcaacttctggcaattataaatgagaaaaagagaaagctagcataaatacttaaaattaggacagaactaaaaggagtcagatagatactgggcagatgatgtagtctaagaaaatatcaaaaacaacttaattctatatatttgaaattttgttagaagcaaatatgaattaccagaaattaacaaagaattagatcaattcagatatctttattgagaaaaacagcctaggaggaaacccactaaatcctcatagtgtatagtaggatttattttggattcagccttaccttgttctatcagttactatgtgaccttggccaggatactcacctctttcagcctcatttccctcatctacaagaagggggaagagttatttcccttacatggtgttttgtgacaatcatattaaatgatgcacgtgaaatgcttagcacagtgctggtccgtcactagtgtacaatacatgatggccatttacattgagcagaaactggaataagttatcaagtactgtgggtccagatggatttatgaatgcattctttcatgcaattttctgcatgtatatgtcattaaaatataatttaaatgtatcccttccaaattttaaggcatagttttcttctaggtgatccaaacacagagaaaatacgatgtttttgcatttggtacacaattataaagatagatgcaacaattctaagtaaaatgatgacaaattaaatccatttgtatattaaaagaatgaaatgccatagcagagtagagtttattttggaaatggtaattgaacatttaatgtgtgataatccgtatattagacacttcataaaaactagattaattagtgatcacagaaccttatgagttatcatcatcatcttatagctaaagaaatgatagctgagtgaggtcagacaagttgataaaggccaaagtaagcactacagctgacattccggtacagtctcacttactctaaagtgtgaaagtactttccattatgtcatcctgaatctgatttaataaactcctaaagttgcatttgataattctcaaccccatcattgatgaaaattcttcaattacttagagtagacacatttttctataatatgttgaaaagtatctgtagtaagcactcaatttcatgcttagtggtgaaatatcagggccattcctaataatttcttttatctctatttaaaaaatttatagatgttctggtcagtgtaataagacatggttcagaaataaatttataataatggaaagaagagacattgtctttatttgcaagtgatacaattatctgtactgcttgccccaaatgatcaactaaaatgataataagatagatatgcaagataatcacatatttaatgaatattgaaaatagcttttatatatgctaacaataccagttagaagagataatggaaacaactcagacctcagattcccattagcaatgcaagtacaaaatactaatttttttttttttttttttttgagactgagtctagctctgtcgccagactggagtgcagtggcgcaatcttggctcactgcaacttccgactccctggttcaagcgattctcctgcctcagcctcccgagtagctgggattacaggcatgtacccccacacccggctaatttttgtatttttagtagagacagggtttcactatgttggccaggctggtttcgatctcctgaccttgtgatccgcccgccttggcctcccaaagtgctggaattacaggtgtgagcaccgtgcccagccaaaatactaactttttaataagaattgtgcagtatatacatggagaagatgacagtgatcaattgggagaaataaataaaaacttgaataaatcagggggctgacacaccattgtactggttaaggacactcatattataaagatgtcatttttcttcaaaattaatttataggtttgacttaattttattctaaattttattcatgagggggtgtcttaagatccagtgaagtgattctagacttcacgtggatgaataaaaaaatgtgtaataggtttttagagaatgggatgggagtaaaaacattcactcaatgtattcattggttctaagattttcaaaaatatgaaattatatgtgttaggatggagcgaatatgataatcaataagtttaaaccttcatgaattcttaaattaagacttctactacagcatatactttcctcccataaaatgcagtaaaatttaactgaataatgcatgtttttcttcagagccttaatgattctataaatacatgactaaagaaatgaataaagtaattggctttttaaaccacgaaacacagctttttagcacttcataagagttattacaagggtgaaaaggaagagaaaaatacaaaagcatgttgagatgtaaatgctggtagttggctgggcttggccaccagttaaatggtccaccccatcttcaatgagcagttgattagaagccatgctttaggacaacggaaacttattgggtccttgccaagttgggttatctacaaagctaagtctgagacaagaactcacatgcaagtgataagttgtagaaaacctctaaggaggtgtagaaacaagtcagggaagtggaaagagacaaagatggctttcaactgaacctaactcccacctcattccacaggaccctcatgttttccttccttgagggaggcaggctggacttttataactctctggcagtcagtcattgactatgggacccccaaagaggcaaaatctcccaagcatctcaggagggagcagctgtgagccattagcagccatgactcacagcagctgggggatgggtgatccagtctataaaatataaaaggagtctgggcagggcactagtggcatttattgcagtcatggtccttgggtatgccttgtggattcatgtcaagaaaatgaataataaagtggtacatgctaaatatataccatagatacagaaaaagagcctaggaggaaacccacgaaaattttgacggtgagtatttcttaatgatggtgattttaattttgttcttattctttaaaatgttgtccatattctgaaaaatatgcgcatgacttaacaccagaaaatagaatagcaacagatctggatagtacatttcagcagatggatcagagttaggatctggctttgctaacttctaacgtgtgggttacttgggctggttacctatcctgtctcagcctcagctttcttatctgtaaaatgggtttgacagatgtgacacataatgttagatattttttgtttgcccagaatctgttccccccttttcctgatgtatcatcccttgcttgtttggaaaactgctcctgccttactccacatgctgctgctgtgctccagctgttcattagaatcacagtaacctccacagtggtgagtgtctaacccagactcacatatgatcagaattttctccagatttttctaatttggagagcaagttctcttttccttgggtcatgagttttatgactgtaaggtaggactgtcagcagctattttgcatgctacctggagaatgtctttctgaatttagcacaacaaagaaagcagcagtaggagtcctggtggccaagcccccactttatggctctgttctgggtcttcaagtctttgcctttgcagccatttttctagcaaagatttttttctttttcttgagctggttttagttgggtttttgtgagttgcaaccaatacagcacaactaatacaaagtctgttgctaggattattgctactgtcatttctgtcatctggaatacccactactcacctgcccatcctgctcctccaccccttagagattgtcctctctttttcactctcatgattttagctcctgatttattgtatgcctcaggttgttagctcataagcatctctgaggttgcctgcataactttaacacatagtaggtgcccacaactgtaaaaatcagaacttgaagggaccttggaaatcatcaagttaaagagaaatagaacgaaagagggaaggagagaaataaatcatcaagtctgtagagtggagatactgaggtccaggctcaagtggcttcttgcctgtgtcagagacatggctagattccatgctcatctcttcagtccactgtgcttgactttttgccctgcttggacactgaataccaagacaaaataaaaaaaacatatcaacagtaggattatttatgtctcagttgagttttagagctggttgacaagagaaaagatgcagaagaatttttctgttgctgctgttgtatgtctattttttacttttagttttctaatttaagccccaatttccttcctaatggtgcaattaaaatcactgaagctccagtggaaactggaacccatctcgttagacaagactgaaaatcaaggagaggcaaaggagagagtcgctgaactgcatgtacctctaacggtgcaagcagaacagcttctacctttgaataaaacccagagatgatgtcctgaggtggtggcagagcctcctgcttgccttccttagccttcaggagctgctctcccagcccataaaacccagatcaactctaaaatatgctgttttcatggagatggtttagtgcttgagatttcttgccagttcggaagcaggaggtcctcaatggggaccaagaggacatctgtccctaccagagtgttgtgttctgaagacagctgaaaccaatgacctccaagccctggaaactccatcatcacttccctatgacctgaaatgttgactcagcacctcggcattaatgatgccttatgctttatttctaaatcatgctttattctggccacaggagggaaactacaaaacgaaaaggtatcaacagacatgtttaagctgcttgggatttgttgcgggaagtaggaaacttgtaaaaggcttatttgaatcctgagaggaaacatgtagtataaagagcacaggctttggaatcaaagcagggatgctggaggtccctcctgtgtgacctcaagcaagttacttaacctctccgaggctgttcttattctattgcagttattctattgtatagagcaataatgttcccaggagtggcatgttctgcaacttaacagttctgaagtgttgaacttgactgcttttagatcctgtccagcatgtttagtggtagtaaagaccatggtgaaaataattgtgctcagccgaaatgagagaactgaaggttgtatagatgatcagggttcatctctccacaggcagcctcccttcagcttttcttctgaagccattgaacagtctcccataccttcccagctcctagttctcctttgatggaaactatagctttcctaacatctgcttcacccctctccttgcttgttctgtgacctattagaatctggctaccaggccaggggctaatgcttgtaatcccaacaatttgcaaggttgagatgggaggattgcttgagcctgggagttcaaggctgcagtgagctatgatcgcactactgcactccagcctgggtgacaaagtgagatctcctgtcttaaaacaaaaaccaaaacaacaaaaacaaaacaatctgcctacctatcatctttaagggtttgcctgtttcttcacccttccctctctctccctttcttaatgcctccctgaggttcaactgtacatttttaacttttaagaaatatttcaaacataatatatatatgtttgtgtacacacacacacacacacacacacacacacacacacacacacaaataagacatctgggtacaagaatcctgcacattttgtttcagaacttgtacatatttacttcagaatgtttatttaaaaaggaagtagaacattgctgacaaagttatcctgctcatcctttccctgcctgttcctactcagaggtcaccagaactctgcagttacttcgtatcatttcttcccctgagcctgtacttctattcatatgtatgagttccttaacagtataaactactgttatttgtgtttcaaaaattttcctgtttattatcctactgtacatatcaattgcaacttcctttttttcctcacccaacattatgttttccagatttatccattttgattcatatgcgctattccttttactttaaatgttgtgtgaataaaccacagtttattctactgagaaatatttaggttgttctacttttctctattatataaattgcagcaataaacactcaatgtatctttttggtcacagctgtgagaatagcttcagtctggacgtctggaagtagaattgctctgttgtgaggcagattgtattagtccattctcatgctgctaataaagacctacccaagactgggtaatttataaaggaaagaggtttaattaactcacagttctgcagggctggggaagcctcaggaaacttacaatcatggcataaggggaagcagacatatccttcttcacatggtgacagcaaggagaagtgcagagtgaaatagggggaaagcccttataaaaccatctgattttgtgagaactctcactatcatgagaacagcatagaagtaactgtcccccatgattcacttatcttccacagggtccctcccatgacacatggagattatgggaactacagttcaagatgaggtttgagtggggacacagccaaaccatatcattccaccccggcccctcccagatcttatgtcctcacatttcaaaacacaatgatgccttcccaacagtctcccaaaatcttaactaattccagcattgactcaaacgtcaaagtccaaagtcttatctgagacaagacaggtcccttccacctatgagcctgtaaaatcaaaagcaagtcagttacttcctagatacaatgggggtacaggcattgggtaaatacacccattccaaatgggagaaattggccaaaacaaagggattgctggtcccatgcaagtccaaaatccaatagggcagtcatttaaccttaaagttacaaaatgatctcctttaattccatgttaaaggtcccatccaagtccaaaatccagtagggcagtcattaaaccttaaagttccaaaatgatcttgtttgactccatgtcccccatccaggtcatgacagtacaagaggtggactcccacagtcttgggcagctccgctcctgtggctttgcaggatacagccccactccaagctgctttcatgggctggcattgagtgtctgtggcttttccaggcacatggtgcaagctgttggtggatctgctggcatctggagggtggtggccttctcacagctccactaggcagtgccccagtggggactcaatgtgggggctccaaccccacatttctcttcggcactgccctagcagaggttctccacgggggctccacccctggagcagacttctacctggacatccaggcaattccatacatcctctgaaatctaggcagagattcccaaacctcaattcttgacttgtgtgcatccacaggcgcagcaccacgtggaagctgccaaagcttggggcttgcaccctctggagctactgtctgagctgtaccttgggaatggctggaatgcagggtaccaagtcctggggctgcacacagcaggggggccctggaccaggcccaggaaatcatttttccctcctaggcctctggtcctgtgattggaggggctgccatgttctctgacatgtcctggagaaattttccccattgtcttggtgattagcatgtggctcctcgttacttatgcaaatttctgctgccagtgaatttatccccagaaaataatgggtttttcttttctactgcatcatcaggatgcaaacttttcaaacttttatgctctgcttcctcttgaatgctttactacttagaaatttcttctgccagataccctaaatcatctccctcaagttcaaagttccacagatctctaggccaggggcaaaatactgccagtctctttgcatagcaagagtgacctttactccagttcccaacaagtcccttatctctatctgagaccacctcagcctggactttattgccattatcactgtcagcattttggtcaaagccattcaacaagtctctaggaaattccaaactttcccacatcttcctgtcttctgagccctccaagtctctaggaagttccaaactttctgacattttcctgtcttcttctgagccttttaaactgtttcaacctctgcttgttacccagttccaaatcacttccacatttttgggtatctttacagcagcaccccactgcttggtaccaatatactgtattagtcttttcttacactggtgttatctatctgtatttttcttattgattctggattctacttatcagttatacacattgcaaatatattctcccaggcttttaactttgttcatagtttctgctttgcatcttgttttctaatttttttttggtggcatttttctttttatcttttttgtaatgattctttttcttaatgatttttatcttaagaatgatttaatctgatattcatagagccatactggctctcttttcttttgcaattgttggaagtatctttttctatgcctttattttcaacctttctgtgaccttgtgttttgggaatatcagttatacgtatcatataactaggttaattttaaaattcagtttgagtctttgagctgttctattttgcctaagaacacttattgtccttactgacatatttgtgtttattattttgggtccttcgatttactgtgctgctttgctttcttgcttcctcccttccctcagtttactacaacatattgtctttctttttttctacttttactaagtatcctgaatttttcccttttttggggttacccttaaaatttcaatatttattattgatattaagactaaaagtaatccgtttttctttatgacacaaagtctcagaaatgctttactctaatcatcctttaatcttgcaaataattattgtttagaatattagtttcacttttcaatgccctcaaattcatcctctccatcatcatcattactatggttacttttaatcattgtttcgttttgcccatgtgtttaccaatttctgtctcactcttgcttcttgaatttcccttctatattttgctataattttttccctcggattgcaccttttgttagttccttcggtagaacatcccactcatgggcattgaaatctgattctaaagtgtctaggacccatgccatagaccctctccttcctggtcagcttggtaccgtctctcttgccacctagtttgtagctcagtcttcagttctgacatctgaagagtctctcctttctttcttttaagctcaactatttattttaaatatttatttgcctcttttatttgtggggagagaggtgtttaatggactcagcaggacagctctagggacatcagacataattttagagttttttatcagaagaaacaggaaatacaaatatgtatagaatgataactccatttcaggtttatagaatatatcagagccttcctcccaatacttatatcactataaaatgtaaactacaaattaccaaatttttaattcttatttttttgactggttgtgaatttatatattgatttattcaatttattttatgttattcaaattacagaacacatgctggctgtgtaaaggaaaagctaattattccctgcattctccaagcttctgcatcccccgccccaccaagataaccagtgttgccagcctgctgaacatttcttcttgcagttctccctgtgagagaaggtatacaaatgcatctccacaaatgcagtagtgtgtttgtttctttagccaaacagaatatgtgacttgctttattcagttaagagtattttattatccagtattcctaagaattgttagcttgacaactgtcagatgatcttcctccatcattttgcagaacccaagtcacccattttctttccatccttatggattctgatcttgaactaactctcccatgtctaacttttccctttggacttgaaccttatccttgtgttctggggtagtcctttatgcatgatccaccaaaacttgagttcaaaagtccacccatacaaacacaggttgagaactgaattagcaataactctcatggaaaaaaatcgaggctggtcacagtagggtcaatgcaaatccacagtgtcactaggctgcaagatgatactaggctgagaaaacataattttgaaaccatgaaagtctagctcaactgtctgattgctgtggctgaagacagacctaggatctattggtccaagaatcagtctaggacaatgatgcttcactttggctgaacatccaaatcatttacaaaactttaaaaaatacagatttctaggcccaatccttatatattttgacaatttgtctggatttggggcccaggtattgtcatgaattgattctaatgcttagcccatgttgagataggataaaacccaggatagcatgctgactcaccatcagaggtagtctctttgggaccatgtgttctcaaactaatcattggagatatctagatttagctatggtatagtgaaaagggcttttgatgtggaattagcagatttggtatctagccacagtttgccacttacttactgtgtgaccttgaacaaatcgttttcctctctgaatctgttttctcatctgtaaacatggagatttatgatctgtgtttcacacagtggttgttaggatcaaaagacaaaatgttcttgcaactatttttttgtaagttgtagggctctttagaaatgttgaataagaggtcttttctaggtctaaggcttgttggttctctaaatagcgattgaccttttctatcatgtaggcctgtgaatccagtggaaaaaatgtgaaatattattctgagtgttttgattttctgaaatgcttccttcaaaaactctccaaggccagtaatttaggccagatttagcagagtaactgaaataatgaaagtaattatccaggtcattctggtccctggattattttccctgagaaatatccaaataatttaatgcaagagaaattctgaattaaaactgtctacattgttgatgtagttcccttcttgcttctaatataagtgaggagtttctaaaagagaatttaggcctttgaatgagggtctatatgaaagggtacaaatgctatgagtaaacttgccttttcaagtggtttagtctcatagtcaaactatttaaatattatgaaagagagtaaaaaacccatgaaaatttaaatatcattctgagaatgctttattttgcagtaccatataatttcaatacgccaaatacattttagagtaacaattatattcttcactcaggcgtaagatcacctgagtttgtggatgtttctcaagaagttgttgtcgtagcatttggacaatgtgattagacaacacccggggagttggtcatttccaaactggaagttgtccagcattattaggaacctcttgactggaagaaaattatcgaacattagtttggtactttctctgttctttttttttttttttttgagatggagtctcgctgtcttgcccaggctggagtgcagtggcacaatcttggttcactgcaagctctgcctcccgggttcatgccattctcctgcgtcagcctctcaagtagctgggactacaggtgcccgccaccatgcccggctaatatatatatattttttatttttagtagagacggggtttcaccgtgttagccaggatgatctcgatctcctgacctcgtgatccgtccgccttggcctcccaaagtgctgggattacaggtgtgagccactgctcccagcattctctgttcttttaaaagtaatttcatcgttggtcctctttagccatgtaaatttcttccgctattcccttaaaaaataaaaatagtagaaatagtgtgtttctcttcttctacaaactgaatcacagttgtaagttgtcctgtgaagataaatggacaaaactatcatttcatccttgtcttaaaagacaatcaggtgtacaacataaaggaatcagtctcctccctcttgccattgtcaacatggtgtctctgaatgaaagagtggcttccaaggagacagttttggccagtgagtttgtgcatggccctcttctttccttagatgatctcgaaggtcatgaaagacctgtagctctttcctctttttatcatccagaaaacatcagaacgaggtttcttctttccacctctatttgtgtatgtgtgatcagccaggaagaaaatgagcattctttgagctactacctgcattgcgttgggagtttgcatagacaatattaatcttcacaaaccttctgtaaggtagatgttgtcatgcccattttaatgatgagggagctgaagtttagagacattgcataacttggctaaagccatgggctgataaccagatgagtgggtatgtatgactctagggccagcgttttgccccttaggtcaaggggaaaagtcaaggagtgtatattttctgagccaaaattcagatgctagagttgcatttggcataaagggtatgagatatttgtaattggggctttcatagcaaagtaggaagttgatgaggtgtgtttcagtgctggcttaacttactattctttgtctttctcagctcaggttgactgggtctaagatgagtctcacctgtaagcacagagcaaatttgattgcaaagatgaatgttagtgggaacatctgagtagcaatgaggcatgcatgctatgacctgttttacctggagactgtgattattatcaacacaaatctgatatcatgttgattacttcattcattcacttaacatttaccaaggatctaccataaatcagataatgttgaagattctggagagagagtgatgaacaagacagaaatctttacatttattgagtacaagacagatgatatgaggataaatagataatacccatcctcaaaggttttacaatcaagttgaaaaatcaaacatattttcagttcacttgattagtaggtaatgaaactaagtgctagaggcacaagtaaatagctaatggagcacagaataggatggtgaaaggccatagttaagttttacagtacaggttcaggaaatgtgttggggctagcatattttaactatgccttaaatcatgggaatggagaaaagagaagtgttcaggactccaccacagaatcttggacacctctaagagtagtttgaagtataatcctaatatatcccagggttccaaatggaccagtcgcccacggtgttacattcccaggaacagtctaggaagcaaaaattgattatgaatatttcaagccaattcctcaaggaaaagagcacgaggagcacaggcaggtttctatgggcaacataagaaggtggctcatattccactggctggaactcagtcatgtggtgttctaggtggggttcttcagaagcaggccttgagatgaggattagtacatgggaattgctcccaggagaagccagcaaagcagcagaactgggaagtggaagagggcaagcatggtgtaatttcaggcaaagtcccagagctggcttgattctgtggggagttctgggagatgaattaggtcccacctcaaggcaaggggtctgggctttcatattctggttaagggctgccccagggcaggggggtacagatgcccagacatgtctggctctctgaaagtacaaggctccattagccaagggcaggcttcaaagtcacaggtaccgccgggcgtggtagctcacgcccgtattctcagcactttgggaggtcgaggcgggtggatcacttgaggtctggagttcaagaccagcctggtcaacatggtgaaaccccgcctctactaaaaaaaaacaaaaaattagccaggtgtggtggtgcgtgcctgtaatcccagctacttgggaggctgagaaaggagaatcgcttgaacccagaggcagaggttgcagtgagccaagattgtgccattgcactccagcctgggtgacagcacgagacattgtctcaaaaaaaaaaaaaaaaaaaaaaaaaggcacagttgcaaacccttggaatcagagcactccaaaacaggaggataggcagacagaaattgaatctagggagaccgagcaaagcacagatagtgtccactccatgtggctacatggaattacaagggaggctggcaaatgtaatctagcagtagcctcaggaagaagagaaaaatgtggatcttggtaaaatacagcagtgccttcctcacctttgtttgtacctgatactcagcccaaatctctttctttttctctgaatacagtaaacacagcacagatgactatttcatcacacttccatgggtgtgcatgggtgtgggggacaggggtgatatgggagtaggaagggtggatgcctccatatattctgagtaaaataaaaattgtacgacttagctcctgtctatagtgatataaacttcaaaaagcattaccatcacttaacgtctttcttttgttctgccatgggaatccccctacctgctaacataatgaccttggagaactttctgggcctgggagtgtgggtccctgggaagggctctggctcccatagccaatgacacaaagcctgagctccttgttctggttcctgctgacctccttggcctcatctcccaccagcctcctctccctctgaacatccagccattcctgagcacatctgactgctcccgtttcaaggacctccttttttctacctggaaagcccactgtcttccttgttggcctgttgaacttctcttctcttaaagcccagctcagaagtcacctccaaacacactttcccaagcttgcatggataacctctctttattttagcaataaaaataataaaatagttactatttagtaaacatatactccgtaccttataaacattatctttcacactaacctggaaaaggaaatgctgttatttgtgtttcacaggtggtggagaggttgggcagtcaaattggatggcagtactctgctcaagagtggcaggctaaaaaatctagaatatgattgtatttattttttagggtatcatcaaaatgaaaatatacaaacatgcatatatgtacaagcatacaaataatacatatgcatctatctatctatctatctatctatctatctatctatctatctatctgtctatctatctcttccttttttcctatctacgtacctacttgagaatttgagaatccccttctgattgagaaataacattcctggcacatcgccttcctctgtcttctgtcaagcccaccatgtctctgtatctgtctttcattgtctttgtgtgtctctctctctgctccttctcttgctcctctaccctatcctttcctcttcccttcctttgtggccccaaagcctgcatgcttcttgttctgcagtgcctgttcaaactcctagcaaggttcaaactcctagcaaggttcaaactcctagcaaggcaggatgtgccatgtgaccctagtttttgcagataaatagcttatttaaatcggaaaccagactctaatcccttctgtgggctgggttgatggatggacgcaattacagtcagttttcttccattagggccctgctggccccaggtactggcagctctctatgggactggttagttatggttggaatagcaatggtaaaggcccaaagtggtggggcttggcagcagacctcagagactgagcactgagacttggcagttgccagggttcaatacattcctgttggagcttgtttggcttggtcccttaccctggggccttgcacctgcagagttgtgcactgtttaggggcttcctgcctatgtgagggtgcccacaggctttgagtgcctttctaatggccaggagtttgagctctggagtcagactgcgtggattcagctcttgggcctctaccaggagacttcccaggtgactttgggcaaagaattcctctctgtgtttcagtttcctcatctataaaatggggacaaaagtaagacctacctcataaggttgttgtgagtgtcaaatgatataattaaggaaaagtacttagcagggtccctggcacatagtaagaactcaagaaatgctaattatgatcatgagtgtcaggtgtattgccttcttcagccctcacaatcagcctgtaaggtagaaattaagtccattttacagtggatgaaacagaggctcaaacatatgaaattacacaggtggagggtcagggagccaggactggagttgaagtatgtaaaccctaagctcaatgcaccttctgctgccctctactgggtgccttctggccaccctactctttgcctcatgatgatgtcagaattgaggcacaacagaattgatgtcacagtcttctttgtccatgaactttttgtttctgcccactgaatacagggtcttaaatcccacagtttttttggagtagattaggcatgttcaggtacatagtcccaaagaggatgatgctgtcataggacagcctggcctggcacttggggcccttgacttctcattctggttctgctactaatgttttatgtaaccttcagaaacccttcccctctctgagactcagtttccctatatggaaaattgccttaccaattccccttctaggtatctgttaattctgtagaaacactcaagctctgggggcacagatgcatgtgctaggagtgttcaatgcaacactgctcataatagtcaaatattggaaacaataattatccaccaaactattgtagcaaataaagacaatgaagggcaactctatgtactggcatgcaaatatgagaaaacatggagagatatattgttgaataccaagagcaagtgacaggactgtatatccagcgtgagtctatttatctaaataaaattatccctgaactctacatatgtataggaatatataggcacatgcattaaaaaaactgtgaaagagacacaacagactattaatgttacttctggggagaagaaagggatggaagtggtggtggttaatggggggggactttgactttcactttttattttatatatctgggtataactttaattttttcttttttgaggtggagtctctctgtgtctcccaggctggagtgcagtggtgcaatctcagctcactgcagcctccacctcccgggttcaaacgattctcctgcctcagcctccaaagtagctgggtttacaggcatgcaccaccacactcagctaatttttgtatttttttttttagtagagacagggtttcaccacatcggccaggctggtctcgaactcctgaccttaggtgatctgcctgcctcagcctcccagagtgctgggattacaggcgtaagccaccacacctggccgtaatgttaatttttatgctattgcattaatatattgcttgttcagtttttttttttttttaagtagcaaattgaagggacaggaccgaaggattgcttcagctttgatgacagcctagatggtcgtggtcctgtgtacaccttcatcttatttctcctcacccagggtcaggaagggtctctgggcagtaaggaggattccaggcctctgctactcatgaccatcttttcagggagccaggctgtccttgactggctgcttcagggcttgggggatgagtcagagggacacaaaagaacaaggggatttctctccagttttcttgacttggccctttgaatctggtagatcaggaactggtctggtcagttgagccctagtggccacgcaggacacagtttgaagtgtcagaccaaatttatttatcttccctagtctcccgcagtttcttctgcttacatttcacagaggactgtaagagcatgagctccaggaaaaaagtacctaaagagaagctcagaggagagtgcagctctattaaccagtgtttctgacgatctaagactgttggattgcagaaaaatcaattgatttctcttttgtttcacttcagtctcttcttcacctaagaaatgattttgttcaagttgttttcaatatcagtatcattgagcctaaaaaggcctcaatggctcattgacttggtcttccagggaggtactcaaatatgaggcacaataattttctaataacaccccaaattagtaaaaaggggaaactgtagcactatattttgtttcatccagttctcagagtatgtttacattggtcctgaaaataattttccttcttgtaggatgtcctgctgtgtaaaagttctttaaggaacacatgggtagaaaaactgagactgatgactacctggcaatcgatttgttaaaggaaaggaggaaagaggtgaaagcatctcaaaagccatggccaggtgtaaattcgtatttgaatttatttcataagtttccaagcctctctccccaagcctattgttttcctctccttctttcttaacagcattcttcttgtgatggttaattttatgtcaacttgattgggctaagagatgcccagattgctggtaaagcgttgtgcctgggtgtgtctgtgagggtgtttctaaagagattagcatttgaagcagtggactcagtaaagatgatccaccctcaccaatatgggtgggcatcctcaaatctgttgagggcctgaatagaacaaaaaggcagagaaggggataatttgctctctctgcttgaactgggacatccatcatctcctgcccttggacagccagtcctcctggttcttaggcctttgggctcagactgaatttcacccccagctttcctgggtctccagtttgtaaatggcaaatcatgggagcttttggcccccataatcaggtgagtaaattctcgtaataagtctccttgtacgtacttctgtctctcatatatgtatgtgtgtgtgtgtatatatatgtgtgtgtgtgtgcgtaggtatgtatgtatatgtatgtatgttgatattggttctgtttctctggcaaaccctaacacacctgccttgtgtaactctcccaccttttcttttgcatttgtctctcttcccttctctttgggtctcttctttaccaaccagattcagcctgtttttctattacttctctcctctctctcagcctcttccctttctttgacctgcataattttctgtcctttcctttcctctaactgaatttgtcataatttgaaaattaaatacatttatatccttgctatattttttaccagtgtatgttatgttttctgtttttaatttaaaggcagaagaaatggagagtttatatttcatcctcttagagttacagagaaaattacaacccaaccaatatcggccctaaactaagatgctttctctatgggactcttgatggatcttttttgaaggggtgaaggaatcaggaaacgttgataaaaggaagttcctataacctttgggaatgttacagttttaattctgattctcactttagattttgattcatttaacaattatattactggcattgcagaaatataagtaagagggaatgtactgacaaatttgggtcttccttctttagcaaccccataactggttctattttattttcagaatatttcagggagaacacaaagacagaaccagatctgtagctgggaaatctaagtgtgaaccctctatcagccctactggttctgtgactctgataagtcaacctctttgaggctcaatttcctcatatgtagaatgaaatcaataaagctactttgcaggcttgtgaggattaaataagaaaagttatgtgaaaatatgtgattaatcctaggggctgaataaatgttagttcattgtctttctttctaggctcttctgagactgatttcctctggatgtgtatgactgtatggggttctggggacttgtggaatcatccttgagaaggggtcaggataaatataagagactaatgaaacagatcatcttgcaaaactcagtttttatgtcacttccttcaggaaggcttccttgacttctcacctcccaagatgagttggctggattctttttgcaccagcagcactctgtccttagtctgactcacttttctatgcctgtcacaggactgtgccatccttatgcatggatgatgtcttatttattcctggatccccagtgcagagcagagtctactgaaagcccacagaaaatatggagtaacccttcattaagctttgaatactttacatctttacatgacctgtctcacttcgactgcataactgtatgaggtcaccaattattacacttattttataaacaaggagactgagtctcacaggggcttagtaacttacccaagatcacacatctggcaattggcagagatcatctttgaacccagacaatctactttcagacctcctgtgcgttgccactatctaatgcagcagaaaaatgaaggaatgaataaataaagaataaacaaatgagccttgtggtgttgaaggagccactcagggcttagtgatataattaacttcattttgaacttggtcatagtgaagatatagcagccttagaaaccaaattcttgacactttcctcctctctaataagagttttgaatagcctgaaatcccttacctgtcttgataaatacaaatacaaagacataaataatgcattagtttctttcccttgcagttgaggctttgcagccataattctgccctacagccagcagacttggagggtggggcaggggagaaaggtgaagtagcgtcttaaacagtctaaaataaattccctaggataattaccaaacagagttaattccataaatttgatttaattggcagcaggcaaatgaaatagggaagaaaaacattctttttttttttttccaagtcattggtggtatctctgaagcagaagttgggaaatcaggataatgtagaaaccagcagcagcccccataaaaacttcacattcaggagagaggaagaaagagactccattactgggcttctcatctgactctgtactcaaagcttatacacatgatccaacataatttgtgtgaccaacttgagaggtagatattattggctatggaatccattagctattgccatgtagcagacaacctcacaactcagtgttttaaaacaatggttttttatgactcacatgtttctggattggctggagcttgacttgttgaagcctaatttttaattggaatagctttgcttctcactgcaagtctgtgagatggctggtatggtctggtctctcttcttctgttctgtcagccaggatattttcatcctgtgttgatggcacttctgttcatatatcattggccaaacaagtcacatggccaataaaaagggcagggaactttactcttgatgaggccatggtgagggagtaggtacaggaaagggagaagaattgaggacaatgatttaataaagcaggcattattacctccgctatgtagacgggggatctgagttcagagaggtggaaaatttgccagatcacgtggctagttgtgtggaggaaagattcaaacccagaattattgggcaccaaacgccatgctttctctcctgatgctgattctgaacgaaaattctatgaattccaacttcaagaggtcattgagatcttccttgacacaaatctatatgcttttgtgtcctagaattaatctctcagatgagtgagaaattgaacaaaatttaaggttcatgtgcctatataattttccatcctttccacttcactcacacattggcctttcctggattcattgcatgcgaaagcgaggtcagctagcaactctgttgtcctttccctcactctgcagaacttatacttacagatctcatcaagtagggctctcccaagatcgcatcctacccaggacaagtatgccttccccaggctcattctaggctctgctgtgggtctggagctgtccagtgtcctgaaacaacccaccacgagatgggtttagtgaatccagctgtaagcaattaaagaacccacgtgtggcaggcctcatttggtttaggcagcttctcttctggcttccttcctcaagtgcacttgggaacatgtattacatggggaactgttagtaactgtaagcaaactctcagggcttaaaagagtgttgctacttgccacgttaacagcaagggattggtgtggcaattcgcagaaactcacaagggaattcagtaagattttcgaaggtgctttgcagtttataaggtccttacacacacacaaaatctgctgtgtgagactgaattgggattcctgtgcttattgtatggataatgaaactgagttgcagaagacacttcctcttccacagtcatagaatggtgcaaaaggaagttacaggactagggagttctgaattatttatctttctccttccatttgtcctgtcaacaaataggattttttttgagacagtctccctctgtcgcccaagctggagtgcagtggtgtgatcgcgactcactgtaatctccacctcccgagtagctgggactacaggcatgcaccaccgtggccagctaatttttgtatttttgtagagatggggtttcgttatgttgcccaggctggtctcaaattcctggcctcaagtgatcctcctgcctaggcctccaaaagtgctgggattacaggtgtgagccaccccacctggcctcaagaaataggatttgattaattgatctatttaaagttctttggggacacaaaaaatatggtcatacccccaaggagattgtaatcacatttgtgagcgtttggtgagggcaaggtgagtacacaaataaggatattggaagatgaaaagtattagctctgagcttcatccatccaatgatctaataaatatatattatatgcctattacattccaggcactatgcttagcactagtaatacaaaagtaaataaagcagatattgccccttcccattctagaaaggaagatagttactaaagaagtaaccaaacaatggagccaacaattactaatttttatgaatgctcttaaatcagtaaatgaataaaatatttagataggataatgaggatgaagggagagtcctacttaggtaaggtggttagaaaagacttctctgaagatgtaacatttaaggtaagatctgaaggctgaaaagtcacctgggtaaagggatgggataagattgtttcaggcagagaaaaagtcctgaggccaaataagattgggatgatggaggaactgcaaatgtgctcacgtgactaaagaacagtgagggagcagggagtgattggaggtgagatcacaaggggagacaggagccagaccatgctgggccttctacgccaccataaagtgtttgtcttctccttttctattatgagtttcttggtagagagcctgggataaagtaggtagtcataacaggatgtcttagattggacactctagaagtagacattggaacaagaaagtgggtgctagtagtttatttgggtagtgattccgggaagcaccagtgcatatgtggggaaaaggaggaataaagcaagccaatacaggtagctcattcagcatgttgctgctgtgggaaatggggctcagtccttcagggaatctctcggagagtgtgtgccacacctgagttattctcactgagaggcaagagagcaggggtgtttatacaccagctgcccttaggctctggtggggggcatgaactctgatacctccagcctgtccagagggccaagcaggcagagttgcaggtgttttcagtgggaagtcaagtctgtgggcatgagaatggggagtgctgaaggatcatcattgggggcacttacaatgtgtgtgtgcacgcgtgtgtgcatgtgcgcacacgggctgagaggagcaaggacaaaggaaggtggagatgccaaagacagttggcataaaggagagtagaaccctgccatctggggacacccttctcagagatggcactggggacagctgaccctggggcttgctggaggccagaggagccatatccctcagggttatgttcctaccttcatgggtgtgagctttgctactcagctcttctcctgggggcatttgacagagtttcctcccctggcaggctaggcagccctcctctctgcttcttttaaacaatctctcttctctggctcagaccctaagatactgtggggccaaagacatcctattctggggatgtcccacgtttgacgcttaacacttttatcccccatcccccagacatatcctttgtttctaagccacaactaggtctggggtggggactaggaagcattcacattctaagggcatctgtgggatgtaggactagatgtgtggtttggagatgcctttctgaaacacatttaaaataagaacttgtgttctccacagagccctgggtaattaatgaggaaagtcatataccacatcccttggtgatataggtaataacacccaacattactgaacttgtttttgtagcttgtgaaaggctagctaataaattatctcatttgttccccacaacaacccaggaaggcaaataatactgttagttccaactaccagatgaaggagctgaggttcagaagtgttcattactttgccccaaacaacacaggcagtgaatgacagagatattctgtgagcatttttcttctggtgatggagtgagcgctttaccttaggaacacttcaacaattttacagtgaacatgacatcccttcacttcagaactatttataacaggggtcttggagatggcctacctatataacagtagggcatcaaatgtcatggagccaataaatccgagggccttgaggtctatgaatacaggtggataagtgtaaggaaagcagcttatataactgttctgaaggttggggtcagaaaactttctcagggaagggctggactttgcaggtcataccatctctgtcacaactactcaactctgctgttgtagtgtgaaaacagccatggatttgttggtgaatgggcatggctgtgttccaataaaactttatttacaaaatcaggcagagggccagatttggcctcatggcagtaatttgtctaaccctgctgtagtgaagactacattacagagattattttactatttctgtcactagatggtgtccttccattagtaaggtgaaatcaaatgctgggctgctttatcatgggtagggaagtggggaagggattgaattatggtggcaggaattagtgtgggaggttgggatcagagaaaagagtttaagtgtaattcaaatgacagaaagtaaacacaacagacacatgcacacacacacacacacacacacacacccattcacgcatccagagtagctactgtgttccaggtacagtgcaaggtggtggtgcacttggtaaatgtttaacaacagactctctgaaaaaaagaaaaggaactcccctcccccctaaattgtagcatttgttgatttctgtagtggaaaactcacatcatgcctgatttcaagctactaacttgctatcaatctgtttgtaacgtacctaccattgaaaaatggagtcttgtaagctgacgtagccagcttcaacacactcctggctcaaggtcttttatttttattgtacctggatatttgtgggacagcaaagttttaaatgcctgggtttcccttaactgtgcttcgtggtgagatcatctaggatctcattcatccagaagtcacttactcagcaacctcagttatctagactatagcttggagccaagaaacaaatactccccatctcctaggcagcacgtgcaaaaatagatgtcattaaattcatgaactctcagtcagcttactcatagaaaaggacctcagttcttcattcagagtgttcttagtcccatattaagtacaatttaaatgagaaaatggttaccaggtttttccacctagaaattagaagcaatgaattagaagggatagtagatccaaatttcataggagcaaattcattgtaagcagcaagaaggatccactgattgctagatagtggagggagaaggtgacaaggctatttcaaagtgggatatttggagctatttggtgtaagcgcaaatagttctccaccttattggatttgagggtattgctgtaactgaccacagtcattctcatgctcatagcaaactcatctgagtcatctgaaaaaattggaatgatgcttaagaaggcagagcattggtcaattcatttcagaaaaatctctcttttacatgcttgatttttttatagttatctttgaaagaagcccatcctgtcgcatggacattgtatagcatgaagaaactcttctcctggtagggtcagatgacaggggcattgctgcaacacctttggtttgttttgattagcagttaagggtgataacgttcagtttaaagtgagcctttttttctcatctgctgtaaaacattctatcctcattctttggttgtgggatttgatgcacactttcatttccaccttctcttctgcctttatgaatttgtagactttgattagggtgcctctcaagctacatcttcacagatggaggcagtttgatttttaaaatctgtttttttcacacaggtcagtccatcagtcatctacttcctgccaccccatcccagctatcatttctcaacactttgaacagttgtcttatcctctctgaagacttctcttaggctcctttccttgcccaaataagttgatgattcattcttctctgcaacatatgtcccttctcatatttttatcattgtttatgatcttttttccttaagtgaaacaaaattcttcaaagaaaaacacagtatctcatgaaggtctttacctctggaatttaggagaccacctgttacttccatatacctgtgtcactgccctcaagaggacctgaggcaggttgactggcaggctccaggtgctgtgcatttgggttgtccatggtgctcaggctaaggccaagtctcccctacattgcttctagttcaagaccaaacatttcaggagaactagagccacaccacttgtgcccagtgtggagctcttccaacagaaactttgtctgggttctctctattggcctggctgatacgatctcagaactgcattgtgatctgagatctttcttccctctttccatccctctctcacaggtgtcacactgcatctgtctgagagttctccccacctgcccttgctccctttgtcatccttaggaatttaccccaataacatcctacatatccaatcccatcctggtgtctgcttctcagagaacccaaactcacacagtatctgatgcataataggtatccagaaatgtcaattgaattgaatttatggtgcttttattggttatcagatcttgtcttcagcagattattttttcagtgtggaggttctgtaattaacaggtgtctaagtctgtttagtgttgctataaaaaaatgtctgaggctgggtaatttataaagaaaaaagtttatttggctcctaattctgatgtttggaaaagtttaacgttgggtatctgcatctgatgagggcctcagggtgcttccactcgtggcagaaggagagccgacctgtgcggacatcccatggtgacagaggaagaaagataaagaagtgaggtgccaggctctttttaatcaccacctctcttgagaaataatagagtgagaaatcagtctgtctcctcacccccagggatagcgttaatctagtcatgagggatccacctccatgacccagacaccttccattaggcttcatctccaacattggggaacaaatttcaacatgaggtttgaaggacacaaacatccagactgtaaccacatggttcatcaaacaacaatagccaatgcctccttaaataagactggactatctacgggtaacttgggatcatcaccatggacatttgttgactatataggaatacacactgatgcccccaggacctgctgaaatgtttaagcctgtttacccctgtatggttggctccagatagatctcattgagttattgtgtctgtttttaattggttttatttttttgtctctgtctttgctgtcaatgtttttaaatgctagatctgagagagacttcaaagatcattcatgagtagatcttcagagcacataatcactaggcactagttagatgctgggaattcagggttagataagaaatggtcctttccttcaaggtgggagcaagttctggctccttattttacagatgtcaaaccaatttggcaagatttctcagcagacccattaagatatgggaaatacaagaagctaatatataatgacagcaaagtatttcttcaagatgggcaggtgtggatccaatctgaacctttattgcaccttctgggccccatgtctcagccagctgatgatggcatagaatcacctgcatacctagccctctgaggcatctcaagatttctgtgactaatcaacatactgaaaaagatgttgctgtgagccaactccatcaacagggacctcatgctgctcatttaattgttgatttacccttatgagagaataagaactgtagtgacttgaaaaagatgccagacattagcttggaggaatatccactttcctgcgtagtgtagagtaatcaggatctgaagacccagtttactcctagctctgttactaattctccatgtgaccttggacagggcatttcacctctttatattttaattatctgcaaaattggataataaatactacattacaaataagagaggatctgtatatgaaggcattttataaacaattcactatataagggtaaggacattaattattaattttattctgccacattctttggtgagatcattcgttcatttattcattcaaaaagcatcttcataaccctatgtatcaggcagttctaagtactttgtaaatcttcgcaacactgtgagatgtgtacactattatcacaattttatagatgaagaaagtccaaataagttaaataacttgcccaatgtcacacatctagtaaatggcagacctggaattctaacccatgcaatctggctccataattcatgccattggcgactacaccaaaggacagaatgcctttttttaaactggaatttgactcagtgaaataggcctggaaaaagagagagagagagaaggaaaaagaagagacatgggctcaaaagagaaagggatggggagtgataggatatccataggaaggaccacaaggtagaaggagagcactctggccaggaaagtgatggtcatcccaaaacatacatggtctttcttcaagaagatggttcctccattcaatgtcctggaagagaagagacagagagagctcttgggcgaacaaacttatttcaaggagagacactgataatcaaaagagatcattgttttccatgatgtttagcaagtcacagatccccatgttgatccaggctcctggagagctgctcaacaagcagaaaaggggaaaggccactcatttcttattaatcatgagattccttattgatcatgagaactaactgaatagtgggcaaactttaacattgcttccagtgatcccagcctcctagtaggtacacctttgtgtaatcccctccttttaagtgtgggctggccttgcagactctctctaatgaatgtcattagtgatggatgccacttctaagattaggttataaaaggcaatgccttctctctatctctcttgctcttgctctctctccttctctctctctctctctccctctcatctcactggtgttgagtaaagcaagctgccatgttgtgagcaatcctacacccccagagaatggtgaggaactgagtatttcagtgctgcagtccataaggaaatgaacctgtgaacaaccatatgaatgagcttggatgtagagcctttagctccagttgagacttgagaagagggtagatctcactgactccatgactataatctcaagaaagacctttagccagaagcatccaactaggttgctcgcagatccctgacccactagactagaacatgtgatgtatgtgtggttagggcagaggtgagaccggataagtgaacaactatcagatgggctaggatgttttgactagaaagtcaagattttccatatggaatcactctgcagacattttggtgggttatctgagtgaggaaatataggaaggcgaagagtctgaaacatccttggaatttcgaatcctttaagtctataaattcggcaacattcactgcaattgatttccaggctagagttctctctgcctcaggggttttaattttattcttctaataattctttattgtcattaatattataataaaacatgatgcatatagcttattgcatgattaaggggcttactgaagacttactggacactgtgctccacccacagtctcaggatctggagggttctttgtggagctgccatacttcatgtcatggatgtggaaaatggagtctgaggtggatcctccctctcattctcacagcctgtaaaaggctcctaccccacttgtagcctacagagggttatgatgcatggttaagagggaaggttctaaagtcagagaggcctgggctgatagtctggtgctcaaaagtatctgtgtgagcttggataaattacttaacctctctgagttcatttttttcagctataaaacagggatgggaagggtgccaacatcacaaggcatggtatgaattaaatgagatgatttgcatggggggatctggcacaggtgtacttgccagaaatattggttactattttttgtgatgccacagaatgccattttctactcaaattcattttttcttacctttctctgttgctgactatagaatggttttatgtatgaattatgaataagtcctaattatggtcccagagccctgtcagtactaatccataacagatacgtatgtctacatgttattaattaatatatcaggtatactagttttctgttgcgcatactgacttaccccgaaatttagcagcttaaaataacacacctttaatgccttgcagtttctgtgggtctggaatctgagcacaacttagctgggtctttgcttcagggcctctgcaaggttgaaatcaaggtgttgaatgagactgcagtctcacctgaaggatcaactggagaaatgatccacttccaagctcacgtggtggctggcagcattcatttctttgaaggctgttggactgagggcctcagttccctgctggatgttgaggagatgccatcctcagttcctgaccattgtggacatctccagcttgcttcatcagagcaaacacacaggagtcagagtgaaagggagagagggagagaggaggaaagagggagaaggggagagggagactattagggttcactaaggataaaagttcacagcccaatggacactcactcctgtgtcatggtccatgctttcctttgctgtcctaatacctaaagattgagtctcaggccagaggctgtggacctcactgttacaaggatcctcatgtagggttccttccagggtaatgcacagagatcttccagggagtgagaccatcttagcaccttcctgggggttaagcacaatgacctgctgctctcacccccagttatgtgtgtggtgtgtgtgttaacagaaaggattaacttaggtagtttaaatggttttatcctggattactggatgattttttgttatgctgacacattctgtgagaagtataaattatttgaaaaggtgacatctggtttgcttctactcattgtgttaaaaaaagtggagtgaatgtaatgaggttcaatgtgggtcttaaacccttctgaggcttaacagtgaacattctctccatgcagaatcctagcccagtcagagctctaggaccctgggttggggagtctcagtctggctcagggttaggggttcactgaggggtagtgaccctgtgttttaaaaccaggtttggagattaggcataattcccactatccagatattacattaagcacccagttcaaaaacatctctcaggaagcccatgtccgtctgggacatgggagatctgctaagtccacattcaaattttcattcatcatttccccctagttcccactgacctctcaggtatgtttttcacctgatcatcaggtctcagtccctggatgtttacataatttatttttcctaatttgcatgacagccaagagagattatatattgcagaactgaggtctataaagacgaagtgacttaggtagcaagaagctgagacagggctggaattcacactccaaattctaggctgtttacaaaatataatgtagctccataccagctcccaagagccagaactcctggtcagtcttaccatgggaaaggtagcatcaatatctaacatttctggcaatgactctgatatagaagctcacagagaccctcagcctagagaccttggagcatcccaacagcccagctattggctatccaccactcaggctttcagtttatcagtcctgtctctgacacagcccccatcccacaatccccaagcagatgcttgctgcagcactgagcacataattatgattgccactttcctctggtcagtaagttcttccaggatagaagttgggtactattgctagcacctggcagagtgcctggtacaaaataggcactcagtaaaaattgatagtgctcgggtagactgtggtcatttctggcaggagctcccagaatgggttgtttttatgcatcccttaaactagaatgatgccctcagtgccacagctcatcatagcactgaatgcactagattgcaatggggagttcattcatttatctgtgtttttgttccatctaaagtagaccttgagacaagggtttgggtgtaagtagtttctttgggagaagataacaggacaaactatgactaggtaggggaagtgtgacaagtaagggaggagcaatagctgtgggcaattggagctcagtccgactgtagccttctgagtggtggtgttgaacattctttagattactccactggggtgaggaatctagaaaatttatccaccaactcccatccctcagtaattgaggcttgttcctgggctgctaactccccagcattgtcctgtggccattggtgcatacagaaactgtccccagaagacttctgagttaggacaagtggacacaacatcagggcaccggtcacatctgctcatttcatttaggcagcaaggtctttagtaaaatgtatagctagagtttattgagaaattgctgtgtgccagccacacgtatactcttacatagttttcacaaccatgaggttactattttcagccccattttatggatggggaaactgaggctcagtgaagctacctaacttgtccaggctggtaagtagcagagctcaatattctccctgggtgtgtctgattccacagttggtgcccattctactttattgcacctccagcagtgcttagcaaataagataatgattgggtttaaaagtcaggaactgcaggaatcccgaagagcacttaaaagtccagcattagaggatgaaggcctgagataaacacaggctgagtaaaaatttaaagggaagaaagtgagagagtagaaagtccaagtggctggttcagccagagaggccacagtcagagccaggcataagtattgcaggtgaggagacccagggagtactcagcttgtgacaaggagagcagaggacaaacctatacctccaggcacatccagaagcaccttgcatatcagcagaaagaagttgttgtttcttaagtccatcaaatggaagaggcaataaagaatcagtgggactccaagattgaataactcattttggtgtagttaagaatcaccaaacatgtgatcactcatttgtgatagcatgccagagctgaagcaaccctccctcagaggaccaggtcctcatcatggccagaagaaacgtcttctccatggccatgcagcagaagcaaacaggcatcccacttctcacacatggatcaattgttactacttacaaatggactcttggaatctccaagtaaactgtgcaaagtgggtcaagtaaattcctccccgtaccctagcctcatcacttttgtctgtagacagaaacaatgatgctgtgtggcagtgagggttaaaggaggtcataggtgtgaacctgctgctgacagcccatcctgtggttggtgcagagctcacatggaagttccctctaggcccttccccacctggtctgcagggaacagtgagctcagagccaacactgtagggaggggtacaggggaccctataacactttcacctccaccaaaaggagaggcctctcatttaagatcccctttcctgctctgtgcaaactatggtctgaccacacttagacatggacatgaagcatcacccctggtttgtgagcaacacccagtggcacccgaggggctagacaagggcaggaggggaaaactgacatttcagtaatgacagtcgtttctactgggaaagtccagctgagagaggaaatgcatgcactgtggacctcagaggagtttctcaggattcagttcttccatcctcacctgtgaaatgtgccggtggttgagatggctaaacgttctgattttgccattttgtgatgtgaagatagataactgaaggacactgaagacacatttggcaaactcttccctgctatctggagctgcttgttggaggaaggttgagatgagcgtttatggtttgcttcagctcctctgctgtgcaccaggcctgatgctaggtggggtgtaggaggcacagctgctgctttccaggaggggacagtggctgccagcaatagcaggtaacatttatggagcactcactttatgccagactatgcattagctagctgtatcatcaccacaccctacagggtagattctattcttactctcctttaagagttagtagcttctctcacatcacacaactaagcccacctttttacaccttacagaataatattccacttgacattcaaggagtgccttttgtgtgccaggcactgtgacaggtgagttataaatgtgctctgctttaatccgcccagcaacttggaaggtagacattattttataaataaggagatcggctcagagaggtaaagtggctccctcaaggtgacacagctcatgtgtggagaacctagagtgtaatataagtcactcttacaagtatacgagaaggaaacaagcccaagttataccccagactgttaagacttccaagagaagtgttaggcatgatgtagaaatgcacgagtgagtccaacttgggggatgtgggaggcaattgtggagaagttggtgtctgagcagggcctggaaggatgagcagagtggactagggaaggaagggcatctgtgtggggacacaaagtgcttatggtttgcttcatggtgatggtgggcttatggttagactatctggatgcagtccctggttctataactttgtagttgtgtgacattagacatgctactcttttcccacccttaaaaggagagtaagaatagagtctaccctgtagggtgtggtgatgatatagtgagctaacacatgcatggagacaagccagcagttagtaggctcagaaggtagcaagagagtgggagccaggtgagtaggctaaggtaaaatgtggagaatctcgggttccaggaggggaaccagaccttgtgctgcatcagcagagactgctggatggtggactactgggtggagaggagagagggagtcaccagtgggcattattaggaaggcacttcccacagatatctgaatgtacaaaagttcttccagcccaaacttctccccgatacttcctattcttgcttcttcaccccagataccaaattttgccatgttggtgggttgcaggagcggggttgtggagtttctaattgcagagatttggtttgtctgggattgatctgtctagtggtttcctttgcttctcagagcacagtttcagggagactacttgtggatccagttacatgcaaagtgctttcttcttttgtccccatttaaaaaattaatttattttaaaaatgtttattttaattgacaagtaaaaattgtatatatttatggtagatcacatagtgttttgatatatgcatatgtggtaaaatggctaaataaagctgattaacatatgcattagttcacatacctatttttggcaaaaaacccattctgttagcaattttcaaatatacaatatgttattagctgtagtctccatgatgcacaatagatttcttgcacttactcctcctatgtaactaaaatgttgtgacctttgactgacatctcctcagtcctcccactccctgcccccagcctctggtaaccaccattttattccctatttctatgagctcaactattttacatcctaaatataagtgagatcatgcagtattcatctttctgtgcctggcttacttaacataatgtccttcaggttcatctatgttatttcaaatgatgagatttccttcttttttaaggctcaacaatattctgttgtgtatatatatagtaatgtatattccatatattccaacagtattgttggaatgtatttatgtatatatatatacccatatatattccaaggtattttccgtatattccaacaatattccattgtgtatatatacacaatgtttattcattgatggacacagtttgatttcatatcttggctattgtaaatagtgctgcaataaacatggaagtgcagatatctctttgacatactgatttcatttcctttggatatatatccagtagtgggattgctggatcatacggtagttctacttctaattttttgaggaaccaccatactgttttccacgattattgtgctaatttatattcccaccaacagtgtgcaaaagttcccttttttttccccacagtctcaccaacattttttatctcttgtcttgttgctaatatccattctaacaggtgtgatatctccttgtggttgtaagtggcattttcctgataattagtgcacagtgcttcattcttaaaggggatgatgccacagagttgccttccaacctagccatggagacaggagaaacaggctgtctgagcaggttcagcctccattccttactggaggggccacaccgggaggagaaggaggttagattgctagagtctttttcagtcagggtgggctagcttggggtctgtttaactggacttgtttaaagttgaacaaagtctaagagacttggctttctctggggttcctggtatatattgatcatgatagagagataccttgtgagatgactgtggaggattaaccttctctaaaggtgctcctaggaaggcccatctactttccctcaccatccagataggaattccatcaggaatagctttgtggttcaccatgagatgtcaccaagatattttaagaaatgagtgcaaaacagtgtaaattgagagctcagtttcttagcagtaacatgtatttagtgtgtttggaaggaaaacagcctaaattatggaaaagtgtgatgatcaagatctgacataaatacatcaacaaagactaaatgtagacacagacatcagaaatgcctttctcacatgctgcaggggtgtctcctttgcctggcagagctttagaaacacatcatgtgccttcagggggtgttatcttggctgtggtgcaggcaaagcctaagctgctctgatctttgggcctggagtcacctggaggaaggattttcagtatcatattccagattctgtacaaaggttttctgtctgacactagagggtttttggctgatgtgatgctgcagatttggtcagccttttggtgttggttcttgtgtttctgcgtgtgctcacataggactcctagcttctagtactgaaccttagttctgttcgcatctttttgtgacctctgttgatctgggagcagctttccttctttaaccaaggctctgctgtccatagattgctggtgctgaataagtccaatccactactgccctcgatgctcccgttttggggttctctctccggccctgtgactttctgagtataaactatgcttggtcttgttcataacaatctctaaagattgattgatttttgtgagctgccaaagagaagtgcctggaatagcaattgttactgtgaaacagggctgagaggctggaatggtgagcatttctgccacctgggggaggtcgcagggaatatatttaagttgcaattttctccacctcctagaaactcctcagttcttgggttggtttttcctttcttttcttttaatatctcttgtctagacatccaggagcctagtgatacattacattgttcagccccttaacatttatttcataaagcacttttacgtatattaaaaggaaacagttcagaacatagactttgaaggcatgctgcctaaatccccatgatggctttccattgcaggctgtgcaaccttgagcaactccctctttctgcgctcaatgttctcgtataatgggggcaataatatacctactttataaattgtggggatagataaattaatatttgtaaagtgattagaacaagacttgcatgtagtagtcctacataaatgttctttactattataattatcattattattgctactacatttattgtcatggccaactgtttagggtagtggcataatcgaaattacctttgattctagctccttccttcctatgccctagcttcaatccctattaaataaattcaccctgccctaagtatttggggagcttcctgatgctgtctctcctgcatttagtgtcaagcctcataggcctactcatctgctggtgatcactgtcacttgtactcctgccaagcactggtactgccccatggcttcatccagctattactgacttttcctctgttcacccaggtccagcagttcttcagagatcatttgaaaggcccagagcctctaagttgtggagtgacccagagtggagcagggagaatggctcactgccctttggtttacatttttcacaaaggactcagccctcctgcaaagaaaattcactctgccaagcattagtgagcaatagagattttcctggagattaggcccaaacgatggttttattgcataccatgcagcaaaacacctaataaattaaacacttctttagcctgccaggatgcttttgccagtcacctgtccctcagacatttctaagccatggtgctctttcctctcctcttttaaaaataattcagaataatttctatctttgacctctgttggtctgggagcagctttccctctttaaccaaggctctgctgtccacagattgctggtgcatattcttttgcataatgtttggactcctgcttacttcagccctcaaagtgctcatctgagccgctctttggcacacatagtacctccctcatatcagttgctgagaagtcaaatgtttcttcatatgttacacaaaaataaggctactgcccttttgggtcactgtttcactcactcactcaccagccttatagccagttagtgttttcagatctactcaattttgaattattttccaacttgcgaaagctcatgtttcagaatttgctctagtcaggaccacagtcttcctgacttgcaggaatgtgtgtagtgtggtattggatccctccatggggatgggcaccccaacacagctgtagctggcagcctggccttcccttgtaagaccagcccatccaggtatgtgctttcaggaagtaaatcaaacatcaccgctttttagagagactgatgtgtgccctcagagagcacacaggagtcagaatatgcatggcactggcagtggccaagttcttgggtggaaatggcctgtttggccaaatccaggcactagataattgttttccagagtgtggtccacagaacacttgcatcacctggggaatgtacaaaacatatatatttcaaagctttcccaagacttttccaatcagcctgtggaggtaggggtgaagaatctgtatttttaaacaaagcccttagctagttcttccacatcctaaaatttgggaaccactgccctagactgtaagttccattaaggcagggacttgaattctatccctcaagtaaacaatgttgggtcccttctttctcctgatggatatataggaagagtctatttcccaattcccttgcaattatgtgagacacgcaatcatttccagctaatgggctgtatgcaaaaataaagcatattacttctgggccaaagtatagagatgaggggtgagttctccggttctcactttacctttctgtgatgactcatgaggtcacatattccagatggtacagctacaaggtagtggagcctctgtcatcctggcttcttgagtgactgtgtggagcagagtccccttgcagagccgctgtggacatggaacatgagtgagaaataaacatctgctctgttaagccactaaaatttcaggattaatttgctatcacagcataacccagctttatctttaccaatatacaagacacttttatcatcttacagtgatgttggacaatcgatttgtttattattaaaaagtttaatgagatttgctttaagcttcagcaacagttgctggagaaacaatatctgactgcagtgggcagggctgggactagagtgagacaagtgagagacgtaaaaggcccaaactattcatctcagcattgctctcgagagctcctgctttgtaaaggaacaagtaaaaatgatttgtaatctcactcctccttcaggcaacaaagactcactgagaccagcatgccagagctcagcactgggacagaggagtaaataggcattgtcctggtcctcaaggaagtcacagtcaaatgagaaaccagacagataaggacaacatggggtggttgtttcccagaaggaggggtaagccaagggcttagcagcccagatgaagcagaggcctcctccagttggactctgtgggcagctcagctcccttgacaatgactgttgagaaaatgccagccacgcagtgccttgtgctggtgtttggagaagagttgtgtgctggtaattgatggtgtgtacttgttcagatgtcccaaatagctgatgatttgattatgaggactttacaaccactcaggcccaggctcattctggttttccaaagaagatgattccagacacacaccaatcgagaggactcatgctaggcattgggcatagagcctggcacaaggcctggtcacaggaattgcccagtaaagggcagttcttctctgtcctccatgtctgttggccagagttaagtcatgggagtggtcacaaagagggaggaggcaggaaaccttattaataaagaagttgatggcatttataagtaaaataatgttaagtgaatatctgtgatttgctgggcatgagtctaagtactttatctgtaagaactcacttaatcctcagaagaaacccaatgagagaggtattcgctttcgtctcccactgctgctgtgataagccatcacaaacttggtgacttaaagcaacacagactgattacattacaattctggaggtcagagatctgacatgaaactaactgggctagaattttaaggtgttggaagtgctgtcttcctttgtggaaactctagggaagaatccatttcctggcctttttcccacttctaaaggccgcctgcatttcttggcttattgccccttctgccttcaaagctagcagtgtcacctgagtcgtccttacactaccatctctggttctcttctgtctctctcatctctgtttgaagatgcttttgactatgttaggtctacctggattatccaggataatctatttacctcaaggtcagctgattagcaaccttaattccatctgcaactttaattttcttttgccatgtaacctaacatattcacaggttccagggattaggacatagacacctttgggaggggattattctacctaccagagagagtactgttaataaaggaggtactattaaaggaggaccaagaccatcacagtgattgcaagagtcagcactgaatttactaatttaacaaccaagggaagataacttggggaagaaatacactgagtggctccctgaagggaaaatgtcagtgagttttacgtgcaggcaagaaagtttcgttgtgattatgctaattaagaatcgaagtttgcatcctagattagacaaaataaatcaattgatccatacattaaaatgtctttttatattcaccaagcgagaggcttcaggttggtctagggaagatctggtgtcctgaggtcactccaagtccgtagatgtttatctgcttcagttggttagtattgccagtgtggtaaaactcagcattcagtgcctgtacaagtggaaagtccttttttttttcttttaaacagtactattattgttcccagtttacagatgaggaaactgagacttacagacaccacataacttgaagatagtaaagccaggattcatacctgaacaactgaggccaagtctccctttctcctttttttcccaaagcaaatgtagtttctttatttctctataaatcatcagctgaccctcacaatttagttgaatccagaaacataattcaaggtagtcattgaaatcatccctctagttacatgctcagtctattttagcaatacactaagtctctcagatttttttcttacaatatttacccctcaactactctcccaaggctatgtctaaaggggcaggggttggtgggggaggtttcccttgacctcatggaggtgaggaagtgggcaagtgccctggagtcatgtcctccgcctctgcgttggtctggtctgtatagttgctggactggccttttcctggggctgggagcacccaaggtccattagggtcttagtgcccatgatcacagctcttgaaagcctctgtaccccgagcctgcaagtctcctttcttaatcgctttattcaaggactcaagactccaggtgttgccgacactcttctcctgaacccacccaatctaagaggctgcaagtggagaattcaacaatggcacttcctgggggttgagaggctcagatggaaaaatcaatgcttatctctgccaggagttttgggaaaatgcatttcttgagtgaatggggacatttgcagatgaaattcaccaaccatcaggcagccagtgcctcttgcagcagaaaacatgatcagcttctgacattaaccccagggcaggaaggagcagctcattaagctctggcagggatgctgacagccacagacgtgagaccatgtttataaacgacttacagtggggaccagtgacacctcattataggcgcccatcaagggcctgttcttccctctttatctccctctatcaatcttccagtgcagagtctgtaattaggacctgtattgactcttgatcaatttgtttagttaggccgaggaagaacactgctggttacgtgtacacattgaaaaggttgtcatgtgagtgtgtgtgtgtgtgtgtctgtgtctgtgtgttgtagggggcacggagggagggacacaggattcctggctctgcctgtagccacagaagtacgcctgagggattcagtttctctctgatgtggttcctcatgtctttgggggctgccatgacagctggcacccagccctccctgagatgatttgggatgcctgatactttcactgtgttacatagaattgctccctgtgagttgggttctgcactgtgccatgtggattaattcttgcataggccctgacaaacttctccaatgaggaaatgaaaacttagtgtggacaagtaacttgttgggggttaaggtaaccccacaactttgtgaggttgccttaaacacgtaatgtcaatcagaccagaagtgggacaagatctttggtacagcctattgggtgatactgatgcatctacaaacacactgtcattaattgggggtgaggtaggagatagctaggctcagccccaatcctagcaaataggaaaccttgtttagcaaataggctaaattggttgaggacctatactacccctgggggattgctgcctgggctgtcagacagcttggcaagtgacaagaccctcttcctttgaagacaggccaccagaccctcttcattcagcttgttacacattctggtcccatagccagttccacttgcactgagctcatggtcacatgagaatcatatcgtgatgaattggccttccatgcagattctctgtggatagataatggttgattttgcatttctcatacctgaatttaaatactggcattcaggtatattcattagcttcttgtaagcttggtaaatgtgagtctagtccagtaggatggctgtaccctttagttctggacaagcacaaaatcctgaaacttggggctgtgactaagcggctatgcttgatgggttcttctgggagatttgtcagtcacattttctgggagacactgggcccttgtgaccccataaacccatggctattacctttttgtattgaaggaggcaggacttcatattttatttgctgactctgtatttgatactcttcccagtgcccaatatcatcttcctagtcttggtctcccaatgcagacatctggtagcctaggctctgctctggaaaatatggagtgggtttgaagggtgagggttgaggggatgaatatttcaagattctcctgacttggcgctggagaggaaaacaacagaattgggctttctgggtcactccctgggtttcataggttgaatttcagagtttcaactgatggccagctcctctctgcaaagagcagctcaggggctagtcacactctgaaggaagttgagaaaaggccaaggatgaatccctgaccagtagagttcataataaaactcatgcatgatgtttttcatatgggaaactcagttcttcctgagtatggggaaaggtcccagatgcaggctcagaagctggctctgttgttgtatatgttttaaaacatgcctgcatattctctggtgctcctcccaatgagaggtgggctctgtgtttcttctcttggaatctgggttgtccttagtgactaggtgaccaacagagtaggacggaagtgatgccatgtggcttccaaagcttggtcataagaggtgataaagcttcctcttggttcttttggggcactcacattttgtgctctgagccactatataagaatgctacggctgccacgtcgtgggagctcaggacacatggagagtctgcatgtaggtgttccggcccactgtccccagtgtgttccctactgacagccagcatcaacctacagacatgtgagcaagaatgcctctagatgattttggcccctagccattaagtcctcccagtcatccagtcttcccagctaaaacctcaggcatgaaggggtatgacaagtcatcttccctctgacctgtattaattgctgactcagggacactcacattttgagcctaataaaatactactaagttttttttgttttgttttgttttgtttttgagatgcactttcgctcttattgcccaggctggagtgcagtggcgcaatctcggctcactgcaacctctgcctcccgggttcaagcaattctcctgcctcagcctcccaagtagctgggattacagatgcccgccaccacacctgtctaattttttgtatttagtagagatggggtttcaccatgttggtcagctggtctccaactcctgatctcaggtggtccgccttcatcagcctcccaaagtgctgggattagaggcgcataccactgccactaagttttaggtgagtttgttacttagcgaagtataactggaatagccactagccctgtggctttgaattggacctttaactcctttgactcaaatgtgagacaatgacgtccactaacagggtatatatgtgacaatgcacatcgaagctgctggcatgcagtaggtgctcagcaaatcatggtttcttactcttccagaaggcccttcacatgtctcttggcctccccttaggggaatattggtctggactgccaagtcaaaaggaaagtgctacatgggctccactgcctgtttctaattaaaatcataaaaaccttctgtgaacaccttaatagtgtctgctaggctgaaggcaagtttcatgaatagattccttaaagggaacctggaactactcctataaaatgcaactttgaaagaaaccaacctccagggcctaactgcaaccacagaaacaaaaataaccaaattccctcattccccagggcagtagctctcaaagtatgctctgaatctcttggggagcttactgaaaatgctgattgctaggcaccaccatgcagtgagcttgttgtggggctggggtacagaaatcctcaattttcagaagcacccccatctcattgagttctgagactctccacttgggctttcagagctcaagggaaacttcgagataaagtggctgatctcaccatacagaaaggaaagaaccgagatggctccaagaggggctgagatcagcatccctctgcaagttgaggggaggcaagagcagagctcaggctgatgctccccatatagtgctccctcctatccccccaccatcctgcagatattcagcctcattcattacagccacatggaatggctctgagcataccatcagcatacctagcagacattctgatttttcccagggctcttccacaaatatttcggagaactccagggatgcttgcatgcacagcttggatatttggcttcttctcactaccaatttggggatctcagtgatgttcctttttcattgctggacttagcaagtgccttgtgagtgggagggaaatctcccctttcgtggtctccgtaggatgcagtttcctgcctgtaagcagaactatttcctgggatccttctgcttgtctgaggcgtttggtctcttccaaaggattggtagcatttacaaatgcatactcttgcctagacactgttttaagttctttacagagatacccccattttcagatttaagaactgagggccagaaatattaagtaacttgcccaaggtcacacagcttgtaaggggcagagcctggctttgaactcaggaaatctagctctgagtctctgctctgagccgctctgttccagtgagtactgagcccctgcatgctgtgtgtcgggctgtctcccacaatggaccatgtattggcctcatgaaactcattcctgtatccctaatagtaaagagagtgcctgacacatagcagcctggtgaatattccttgtgaaggaatatgtctatttttaggtatgaatggaagtgaagctttaactccacaaggaaacttttaggtgcggccacagggatactgaccagaacaggagaagaggtcctgaatcacggaggcgggtgaggagtgaagttggaggctgactcggtagcctagaggggagcagctgaggctgctgtgcccatgattcagtcactgtgcccctgagagggacccactggctattactgacatgtcaaaagcagggccaggagctgtgggttatccaaaaacacaaatttatgaaaatagccctccctattgagaaacattggctcaactaggcagagaaaagctctgcatcagtgccacctggtgagaactaaatgggagaaagatagctcatgtagctgctgtaaatgtattacccaggaatggcttggagattatttacaagatgctgagagatgcactgatcctatttcagcagcaccatggagaccagcagactggcttgggcccacggtttgggtctttgcttttcactcactttggccagaggaccaaaagtggtcatcgcctggattcttcctcaaagccctgaaaacagcagtgtgtcagtgtgtcagtggatttgctttggaggtctctatgagacagaagggtagagaggaggatgcattcccactgtcttagttgggtttctgcaggagtaactctgagacaaggaattgggtgcaatggcttatttgcgtggtgaccccaggaagctctacagaaaaatggggaagtgaggcaaggagggaaaagaattgtgagagttcgctcctgctttgttttgaagggtctagtcttcagctaacaattgccctaacttccttcagaggattattgagatgacagacaactgcaaaacctaggcaggtcccccagtgagggtgaactgagggatgaacgacaggctgagaccagcagtcagagtggttgtcagacccccatggggaccagtggtaaaactacttctaattttggggaacaagggggagagaggcaagagacgaagttcctctaaatactgagataatattctcaatcaccatctacgtcaatcattggtgcatgtgtacaaataaaaattaaaatatgtcttcatacatccgactgaagtcacagttatccctgggagtagtgcaacgtcgcagacagctgttctcaagtctgagtgaccttgtgtcttctgtttttgagcgtccacattttccaaacttcctggcacaagcaatttccagacaaaactcccagattgtttagctcctgatgaacctgtttgatctggaatttcctcgagacctggctctatttgccagctgaacagattatactgattgatgtgtttgtgtgggtttcaaatcatttctaagtaacgcaaatctgcttagactcccggtgctgactgcagtttgcttccggacatctggggtggcataccctgttgggcacggaaggacaagtggaagccagacttggcacagacagaccaggcctggcaatgggagcaccccagggcacacatctatgcagcaaggcactctgggacccagaagacctggagacccttgtgctctgagggcactctgctgggccctgcctgcttctgagcacagggcagatggcagactcacatgagacctattttcccaggccccagagtgtggctgataaggcaggtagctgcagccacagccagtctgggtggtctctttccctctcagacaccctgtgggtcccagtgatgtcacaagttcaattatgtacctgcttatgtttgtgttttgaagcatttggagctttgaagagtggcccccccacaccccgcatacttccctgtctcccctcccataccattttttttagatcatcaggtaagccttcagcagaggggcagtggcatgaacatttgaaaaagaaggagcagaactcatctctgtgtatgccgttggtatccacctcaccaggagtagggttgagaacaggagcttgggttctcagttgggccccaacctcacctcagtctcaggtgctcaccttgcagatgcccaccatccccacctggcagtgccatttatatttccaaagcaatctctgattagggtgagtccagggctcctgcaggctggagctcccttgctttcctcttacacagtggtcaggaataaagtgctcttccctcctgaaaagatgaggcccgtgtcggtggctttcatcccagctacttgtagaactcataaattagagcagcaattggctaactttttctgtaaaaagccagatagtaagtattttaggcttttcgagtcatagggtctctgttgcaatgcgtcaactctgccatagacaatttgtaacttaatagatgtggctgtgttccaatacattattatttataaaaataagtggcacgctgggtgtggctctccaactgtagtttgctaaaggctgaattagagcttgggacctgagaataattatattggctgtaattgtttattgagtgcatgttaaaatccagtttctgggtcccgtatccagaggttcagattcagtggctctgcggtgggatccatgaatctgtatttttgtaaatatcatggatgattacgaaatgaaaccagaagtgcagtgtacaggtcatctccttttactgatgggacaatgacaacacaattggagcggtactgtggtcttcttcccagcccaggatgccttctgtttccccaccttgctataataccactgtatatttgggaacctctggggaccctccctggaatatgccagaggtgtgacaagctccgctgtgggcctcaatggactcagacaacgagggcatttctcacctcattagttttaaattgcctgttatttagctcaggagatgctggccactgcacagttaagcccagtgacaggaatattaacaagatgcatggaggagagcttggagctgctggagtggacatgagagatggacgtcttgcaaacaaacccacctcctgggccacatgtctctgaaaaatccacctattagtagaagaccagacttagtcatttgcaacttgaacccatttacttattcattcacttaatttttttctttgcatattcggttagcatttatttagcacctatttggagccagctcctgttctggtatttgggaaatagagctaaatcagacatcattgtcttactttactgtgattcatacggtgatgtacgaaggtgctggagaggaagaggggtctatctttcatcagatttgggggtcagtttggggcaggaatctgggctgagtctgtagtcagtctggggtctgatgtcagggatcagtctctggtcaagaaacatagtgaaggtcactagaacatccaggtccattcctgagaataattatattggctggaattgccacagagaggccttgagtatgggacatcttgggtgatgtttctcatggcccaacatgaatcttagtcctgatggtccattgccaggcaacaaggccctactatcttgagcaaggtggggataaggtttaggaggagtccagagtatcttctcacattctcattacagtgttctccactcactggggtgagggtggagggaggtagactgtttttaaggaactggttatattgttttgggtgagagtccaaacatcaactcatcttaagaatgaatccaagcttctaagtagatattttgcactttagagagacagtaatttcataaaaaggaattgctaagccactgcctaactgtgccaatgattttagctgaaggttaaactcacagaatgtcagagatggaggggcccccagggattactctggttaactgtctttgaattgtgctctctggaatcctgcatttctctgttggtgtctgtggtagaggtgtgcttgggtagaggtatgagggggccccttgtagggtctaaggcagcaagggagttagaagaaggttggcctattccatcacctcttccctaccttccattccagctccccagttccacccacattccttctctctctttgggattccaggccattcatagaaggtctactcagctctctaccagtgtcagggctcactcaactgatatgccgaataggtgccctctaaggcagtggccataacatccttcttgtggactctgggcagcaaggggcatagactggctgacagctgtcacctggataaaaggtgagtctgtctctccatgacccgcctcctctgaccccctactgaggccacttagagatatacactgtagaaaaggaatcgttttaaagaagttctctagacgacgagttagtgggtgcagcgcaccagcatggcacatgtatacatatgtaactaacctgcacaatgtgcacatgtaccctaaaacttaaagtataataaaaaaaaaagttcttcccaacacaaggtacattgcttttcgggagtattccagtgagcaggtgtgcttaacgtggcggtacaggtgagcctccagcatcaccatcttctggtcaccttttatttttttatgaagcaaataaaaaggcatttcttaaatctttggaaagttttcccccagtttttgtgatacgttctccttcaggttggatcaagaacctggtttatcacctctttccattcttgtttcaaactcatgcattcttttgatgacttaatcttttgctgactaacatggatattacggagactcaattcgggtctaggtttcaagattctcagagtctaggggaggaggcaagaatggagagagggggcagagctgcaagagcagccaggccagcagtatttgtttttctaagagcaaacaaaaaagatttgaatgcttgagctctgggggcaagggatgtggttggggaggtagaggcagggtaccatttctgtaaactatggggtggaggggtcctgtgcagcctacactgacacactcttatttcctcttgtcttccctggggagatggtgccaggacttagacaaagggaggaccatggggggaatgagaggaatagaaaggcatcctggaggaataggaagaggtgcagaaagaaaaaagcaaggttcagaacaggaggagctgcatttgtgcaggcctggaaactccaactggtctggaacaggtgcctgttcttgatcctcagtggaaccagaaagggtagaagagtaggagtgtaatttctggggaggccagctgatgggggtcgactcctttgttctcttgtagggaggttagctgatcactcctgatcaaagcgtgggtaggtttgtgcaccacatgcatcatgctgccttccagaatgttccaccctccgctgtcccctcttagtcctccaataatgctatttatcgttcctctgaggtcctggtgttcttggaatcttgttgtttttctcattcttattgaagttctaattgtattgagaggaatttagattagtttgacctgagatgggcttttagaagccaataagggtgtttcttttcagatatttagcagtatttgtcttatgaagtgctctcaaatccacactcagagaacaagcctataatttctattcaaatagcctctaatgaggtgacacttttgtcaacttatagggccaagtcaggctgtggaaaaatatatatatttggatcttttggcccttggacaaactcaaaatatgcaccaaatatgctttggagcattgtggaggcatgaaaaatagataggtgagatggagggcttgggaggtctaagcatctttggaggctgtatccctgcatcctttattcacttattcaaaaaccattcaccaaatatcttctttatgcatatgccagtaccgtgttatgtgcagggcagcaaaggatgaataagaacagaatttgatgctgcaagaatgctgtgcatccctgtgtggatatgagtgcacatggtgtatgtgtgtgtgcctgtgtgtacacacttgcctttgtgtggcaggcagacaggtgtatgaataaaacgatgaagtgtgataagagcatcactcatagcatgatgatacaatttatcatccaaattggtacatctttgggacaaaggctaaaccctgaacaataagcataatctggggctgtcttaggcaaactaagaaatatggtcacctgaagtaatgcctaacacaggaaagagcagaagacttcttggaggaggtctctttggacttccaaatggaccctccccatccattcttgacttccttcggttactgagatcccagcgcaatcatcccttcctctgggaagctttcccagacatgtcccatcaggccaacttctcatacactcttctagctctgtagctctcaccttccaagcacttatttctggaatgattatacatgcaattgtgcagtcattgtattgtatatctgcctcccgcacatcatgaagacaggcccatccatgaaggttttgtttaccatatatggatattcaataattactggaacagtgggctgagtcttggaacactgtcctacttagctaggtgcctgtctacctaaagaaagaaggaggggagtgggaaggacctggaaccagcaagtattctggtagaggagcctggtgggcgtgaggtctagagacaggatgatacatgttattggcggggggcggggtacaaatagctcagtgtggctggatcacagggtttgaagggtacagcagggaacggattgtgagaagggagaccacatcctgttgggtttgtgagccatactgttgaccctggcctatatcttccccatcttcttttccttctgagaggtttgattagatgaactctaagacatttgcaaataatctttccttgtggtccttttactagtctggctaattgtttaagaatgtttctaattgttcttatctttttttttagaaacagggtcttgctctgtcacccaggctggaatgtagtggtgcaattatagctcactgcagccttgaactcctgggttcaagggatcctcccaccctagcctgctgagtagctaggactacagataaacacctcacacctggaaaatttctgtagagattgggtcttgctatgttgcccaggctgatctcaaactcctgggcccaagtgatcctcccaccttggcctccccctgtgctgggattataggcataagcctataagacacgcccagcctgtccttacttttttatagccctcattaagataaatatttctctccattttggaaacatcaaacaattagggaaagtcatagaagagatgctaaggatgattccagaaagtgtgctgtttacattgcatgtcaaaacaagatataatgttggaaatggagtcacacgaacagcctctccttcctcctgaatacctgagacaggggcttcctgtggcctaagacaccctaggaaggctgtttctctccagtgcatcaggtactaatgagatgaccaatgagagcactattcccagctctgagagttcacagacttatacattatgcattagacaaataccatcttccatttctcttcatctgcaggtattttgttaaaagtgtgctttttcctcatataaaggttctcttagttcaagatgtgacacatctattcactgggtccctggagcccaggtgggcttaatagcaccttatcttcctcatcacaccagtgcatgcagttttgcaaagaggcactaactggagtcaccttgtcccaaagccatgaagccatttccttaagtgtatgatttggttccttgtaatctcagccactctcatattctccaagcccctcaccggctcacaaattattccagataacagctcccttgtcacctttccagcccctccttcaccatctcagctgaggagagtctatgaagaaaatgagaacagaggctcatttccaaaggcagcgacaagaatttgctaattaaaatgaaaagacttagttccctgaatcagtgaaggaggcttctgagaggcacctagaggaaatctttctccaaacgaatggcctttccagctgggccctgatagagcccaggcatccttctaactgcaggaggctggaaactggggctctgcagacctgctcccaaacaaggcctaatgaggcctcagacccatttctaggagctcctgcctctttgtttttctcagccccaaaagctcacaaggattgacctactcttcagtacattttagaatcaaggggcctttggatcatccagccaagtggttttcaaggaggctacacactagaatcacctggggaggggttaaaagatccccagacctaataaaaatgcatctctagagggggcctaggtatctgaatttgccaaaagctttccagtgcttttgctgcagagtgagaagtgggagctgctgatctcatccaatagccttatttctgggcgaggactctgagggtcagagagggagatgatgttgccccaggccacacagcaagacagtggcagagtccgggtctcctgtcttgccctttagactacacagactgcccctgctctgccttcctcacagggccgtgtgtggatgaaataacataaagggaagatagaaagtgctcagcaagagggcctgtggcctgaccatattggtatgtgtaagcatgtctggagggctgccagcaggggcctctttgcatgcagactgagggacctcataggaaatgttctgcctaagggaaaaggtggatgagatgcaagaaggcggctcaacaatgaagagaaatggagatacctgccatgcagtactatatttgattatgttgaatcatatgaaattgtgatatctgccatttttgacctataaaaaaggcagtgttttttatgattggatgtaatagtttcagaagcaataaggagaagatgagaaaaatgacacccagtgatggccacagggtcagatctgagcttaggtgtctctggttcaaagtctcctgaccactttactgcctcttctctctgttgccttggctgggcaggtgcagtctggggtacacaaaggaagtaattaagcattttcaaactgtaactatgagaaaagtcattcccgagaagctcgaggctggggtcctagtccctggttcttactcatgttttgtttttatcattattgtataaggtaatatccataactcaagtaatcctttttattcttgggaaagtcatggagactttggttttcccatacataaaatggagcaggggggagttggaatctcccagggcccttcttgtctccttaattctaatagtcaaataaaaataataatttacacttgcaaagcactttgcagcttcccaaagcatctttacagtcttgtttggcttggcactttctacaacctgatgagatagaagttattatcaccaaattttggatggagtacattcatctaaagggcccaaagagaccttagacaattgtccaagtcatacaacttgttactagtagacccagagctagaattcaggtttcctcattcctgggtgttagggtctttatacaacattggactggatatcaaaaagaggaggccaaatctgaaaggcaagagcttaaacttgaccttcacagatccaagccccctttattttatcacacaggattagtggctttgtcctactgggatgagggggaaaggattaatgcttgccttgcctctccacagctgcctgactcctcactctctgatatggtttggctgtgtccccacccaaatctcctcctgaattcccaggtgttgtgggagggacctggtgggaggtaagtgaatcatgggggcaagtctttcctgtgctgttcttgtgacagtgaataagtcttacaagatctgatggttttaaaaagaggagttcccctgcacaagttttctctctctgcctgctgccatccatgtaagacatgacttgttcctccttgccttcagccatgattgtgaggtttcctcagccatgtggacctgtaagttccatgtggaactttcttttgtaagttgcccagtctcaggtatgtctttatcagcagcatgaaaagagacgaatacactctgtaaccctaccctgtttcaacatccccaaatcttctgtagaagaaggtacatgcctttgaagttccttgcattttactttaaggtgctttatttgtgagaaccagcatgtgataatggttaggaacacagactgcctggatttggattccaggtttgccacttaacaactatgtgatctgaataaagttccttagcttcttcatgcttcagtttccccagatttcaaatggggataataatggaacctatatcatagtgttgtaagaaggattaaattagtgaattataagcatttgtattagtcaagatatgcggtagtgacaagtaaaccttcacatctcagtggcttcatctataaaggtttattcgtcatctgggctgtgtctgatgggggtcaggtaaccttccaggggcctcatgtggaactcggtgatccacatgtccttcatcttgtgaagcatcttaccgtgattttcagagtttcttaaaagtctgagagtgttgtgtgtcatctcccctcagagtctgttggccagaattagtcacatgggcccaatattattagaatgagcccgcgcagtgcagagaagctcatggactagttggtgaacaccactagctctgccagtgtatataagtatttgttaaataagataaatatgattttaagaagcctcattttttaatgtgttgatagtttaatcctgttactggagtcttgcattttattgctgtttattactttttacttgagtctcaatttaaaatttttatcacttcttattcttttatgtttttcattaattttgctttgtctttgtaacaacctcataaaaagtcgtttgactgggacagcaggagtgggaaaccctatcaacatctgggacatctctaggccactgttcctgccacccagctgtctctgcagccactctcgagtttccttggatgaaccttctagttctttcaaaaatctcaccctgggatgcttctggggttcatggttcagcctcccagggctatgcttccccacctggaattgcacgcttgcgtggttgggaaggtgttgccacagacattttctgcaggcctgatgcaaaaaactgcattttaaaaaatcctgagagtgacatcagtttctgatgcatgttaattttaccttttgtgatgaacaaaccacgccagcagaaagcctcaacccagggggctggctaacagaggtcccatcagggaggtgccctggcccagcgcaggtgaagggtcagatgatgttgatatcccctacaggtatccgcaggtagggtacactatccagcccccaggattgttcttcctgagttactcacattccacttcggcaggccttaagaagattgcttgtgtaataggctcctaactccctttcctttatgggcagcattaagcagaaggcctgcaaagaggggtgtactgtgactttggaatagagtcagctgggagatcaaccgcatttgtcagacatgtaaagcaatgtgagctggctgagaattctaaaatcggaaaagaagggagccttcttcccctgtagagtagaggcctagagttctcttggaaaagccactggggcatcaggaagaatcagggctgccattctctgctctaggtctgtctctctaaaggttgaaagatgccgttctggggcactttggcaggatgtgtagagggatgtctctgcagaggggttttatccgctttcagagttggagccataatgacagtattcccaacatcatgcacatttaatccccctcctgtggcctctggggattttttttcccacataaaatgtctcaagcccttattccacaaatggcctgatttcttgctgggccccagatggaggcctctgccccctttttttccctgcaggcaggcctgcactcatgggcccttccctagcctttggcctataccactgtttctgggaattttctctctttggttgattctccagtacacctcactccagtcctgaaaacctaaaatctccttgtcctgcttcaaaaactggaaagaaatgcatagccgcagaccagctgagctgagctatgctgcctgtgtctcagggagctatgacttttacaggtaagacggctcacttcttcaggttcagccagcatcctggaggatgctcctcagagacagcacatttattttgttcttgtctgtttggggttataaaggcataagccatgatgtattggattaaaaagtagttaacaatttttgcgtttcaagagacctggattttagtcatattcctagtttcagatctgttacttttccggtggcataggtaaagaaaaattggccaacatcttcctttttgttagagtgtataccatgtgattgtctttggtttttgtgacgagggcattttgtctttctggttctgtcaagcaggacatgagctgtcttagcacgtttcccctccgaaggcacccacagtctgtttggacatatggtacctctctgaggatcttttagcttgcacttgttccacaaccccaaagcagcattacttatctctggggaactggatgccaagctgtctgggtgtcccttgaggccctgctgggggtgattagtgatggctgattgctctccaaggccactctcagagacagatggattcacctccgaggaaaatttctcacccagcttcttattttgcacagaccttgctggaactgactggtggaatgtagcaggaatcggagggaagctttactcatcattccagtccagggaccaacataggaaattatattaaaattggttcttctctgcttacttccgtcctctagttgcatattcttaatcaggtaaagcatttgttaaccttgtttttaatacttagaggagtgccctggagcctgtctgccctcatgattgtctggagaggtgagaagaccaggagtagtaaaacagaccaaagatttcccaatttctcttggggaagtggctgggattggggatggtggccaatgggagcccaactttattggtaaaattctgattattttatgagaagaatgtatttttgtatcatttgtgtaattaaaaaattaagcaaatgaataatatgaacacttcagttcttaaacattgacaatgtatatactggatgtaataaaacgcactgaattgaaaaaactttgctttggtgatttgtaagagaggagttttccctgtcattttcttttgctttgatcaggggatactagataatatcaaaccggctttatccaaactgtatattgacaaataggagacttgtcttcccaatatctggtgtgacaaggaatctcaaagaattgatcagaatgcattccttcattggtactatgtggtgttaattattgtagcactcttgaaaattgtttggttattcttgtatgtttatgtttttcatattaactttaaaattgttttttccagttacttactaaaagactcatattgattttgattgaagcggcattaaacttattcttttagtttacggtagaattggcatgttaactatagtgattgtgactgtctactgaatctcttagtttattcctgtcatcttttaggtctcaagatagagttctatagctttctttatgtgggtcctgcacatttcttaagtccattcctgggcttcctgtattttgtgctgctattgtgagtgtaatttttcttttccattatgttttctaatatataattgatactatactaatgaatgaattcattagtttattctacaagtatgaatagagaagctatttatttattttgcatacttattttataacctgtgcctttattgaattttcttatcagtcttaatagtttttggcattactagacatataccaaagattgaattaactttgggccttcatttataaaagtaattgtggtggtcttaaaacatttatgaaaatctttaatactgcttttataaaaagaacaagtctatgtcctcttctcttgaatcactgctgacctcagtgaatcctttgtaacctgtagaatctaacaagtgatgagatgtaacttcaaaggtcaggtgggaaaaggttacttaggtttcaccaggatctcttgggacactcactgtgggtgaagatatgggctatgtaattagtctgactactctgggctgtctgtgctgaagaggccacatgaaggcactttaattgacagctccactgagtctcccagccaacagccagcatcaacagcagccatacatgtgagtcgtcctggacatccagcccagtcaaggcttaaagatgtctgtagtcctgacatctgtaaccacatgaaagacccttctcaagagctgccagactgaaccctttcagaattcctgacccacaaaattatgaaaaaataaaatatacttgctttgggataattggtcacacagcaacggtaactgtaacaatgatctcttagctattgattaatattgctagctgcattggcatcatccaaaaatactaaattacagcaaggatgtagacatccatgactttactagaaatacacttagattttctctgttatttaatatgcttgctgctgatatcatgcattttgtagtaataactctcaaagcttagtggctaagaaccacaatggtttatttctcatacacacaacgttctgggagtccagtaactcccaagagtaactatactccgtgtggtgattcagtgatccaggctgagggaatctcccccatccctatggctgcaccatctacaatgcaggacctccttgatagatgactcaaggaaagaaaatgctagagagtctctcaacagtcattaaatactttggtataaaactgatacattatcagttctgcttatgcttattggtcaagacttgtcacatgactccagctaattacaaggagggtgagcggtgtaatcttcctttatgccaagaaggagtggagaagtggatactggtgaactctagtaatatctaccactaattattttaacttcttatgctaacaaagtatcctacaattaatagcttattgaggccatcatatttcatcaggaattgatattaaattttgtcaaatgttttttaagtattaagatgattatatgtctttctttttactgttaggcttcctcatattgaagtatttttgaattcttggcatataggctacttggacttagtatattactttttttttttttttttttgagacagagtttcactcttgttgcccaggctggagtgcaatggtgtgatcttggctcactgtaacctctgcctcccgggttcaaacgattctcctgcctcagcctcctgagtagctgggattacaggcacgtgccaccatgacggctgattttttttgtatttttaatagagacagggtttcaccatgttgaccaggctggtctcgaactcctgacctcaggtgatctgcccgcctcagcctcccaaagtgctgggattacaggcatgagccactgcgcctggctggtatattactttttaaaagactatgggggtcattaatgattttaatgtaatcattaaaatttagtaaaaatcttcacatttatgtggctggtttagaggttgtaggggtttttttggtgtgtattctgtcaaatttggtatctgtgcaatttcttcataatattcataatatgaattaagctttcttttatttgcattgttttggaatagtacatactgcataataactattttttaatttgaaagttcgatccagctcactcatgaaactacctgctcttgtatctttcagagatgagtcaacaacttaacaaaactttcttctctgatagcaggtcaacttgggttttctatttcttgagccaattttgataatatacatcatcaagattttaaaatttactagccatgattgttgatgatatccttttataattatgtataatttctatattcactattatatcccctttctgtctcctaattttggttatttgtgttttctctcgattagacttctcagcaatttgttttgttggatacaacaacaaaaaatttcttgtgtttagaaaatctagtgtttttctgcatctgtggagattcattgtaaaatgtctttcttttttttggcagagacctgatttcacaggcaggcacattctctcattcctcaaagtgaacctctgcttttgaactcctgcatcttttcatgtgtctggtgatgttttcctgtttgttcacccttacaagcgaaggtgtgagcttgctcagagttggggtctgggctgccagagagcatcatggaggggccagaaaagggaagggatagttgagatgtgctgttatttttctttagcaggccagaaatttgacagcctgtgagggcagagagcttaggcagagctggtacggggagctagtacaaggagcttcatcaaccctgggagaggtttgtatcggcatttagtgttggctggaacgcacgcccccatctgttttcctgtcacaattttctccattaggagctagctgcctacatggtttgtcaggagccatgttctgccaaggataggctgggcgtaagcattgctgcaagctgcttactctgcatgcatggatcccagatccacatactctccaccccactggtcaaccaccctcttgctcttgcaccctatgctagggctctcagtgggattttagtaaaacaggaccccttaccatccttcttactgtctattgggtaggctcaccaagtattttcaacaaaaatatgagatggcaggactcctgttcccaaacctgagcaggaaattaatatcttgacacataggatgagcttaggacatgagtagaacttctcccatgaatcactttacatcaagtccattttttatccctagatcaaaagcctggttggacatctggcggccctctatgggtgttggcagaatcccatttcagattaacagctggatgataggctattgtgcatagctgaagcccagtttcccagctagtgttcccctgaaagcaaaaccttaaacgaaattttttttggaaatatgattccaggaagcaatgagaataggagttgtaagtcagggaaggaacgagaaagaggtattacaaggtgtgttatagagttggctactcttacagggtctgcttgttctgggaccatttgaaaagtcgcatgaaatacacttaagaactgccttcagaggaaagagaggaggaagcatttgttcacagcctccaggcccctatcagtcaaagatttcattgttaacttccctgcatttctgggtagcacactcacaagtgctaagtgggttcctgtgggcatctcagagaatagtaccagaaattgtggcacaggaaacaagagctgcagagcctgtctgaggaaaggcaccatggacttcccatatatgaaatctgaagaagcatgcttggaaattgttcccatggccgtggatgacataagcggttaggctgagaatatttgaagtggtacacaagaggcatctgttttacccagttttgtatgccaacaaggtgctcttaccactcccttcctctctctggggtgcttcaaatggatttgaaagccaaaatcctcagcatacatttcttcaagattctctctgctgttttcctgcccatacaagtttttcttaatgtcatttcatctcccaggagatagaaatggacgattgaccaattttctgagtgagtacagaccatctggagcaggcacctgggcgggatgagccactttatcttctctgaggcttctttgcatcttttaggcagcaaaacatgattcagcatcaaccactgattacgattctcatttcagcttcttgtgtcttgtaatcagaggaaattcctcccggattcacacaatagcttggccgccaggtgtggtcccatgtttccagctttgactacatatttgtagggattttaaaggaaagtgggatgggatggagtcagtcctcattataacccggagcaggggtttacttcttggccctgccatgcctcgccttaatagagaaacagattcatcttctatctcagcacatgtatctgttaggctcttcatcattcaaaaggagatactaattctctttctggctcagctggctcttaaactcggactccaaattcaatcaacaactcagaatagctatttcactggttctgggctaaaagcctccagctcatggacactcagagaggagagaaaacttgtttatataatactaaagattctgaaaccctacatctggcttaggtctgacttgcagagaaccatgtagctgggccccttcattttggtccttcagtgaagagctttcactgaattgttctatggcatgaggccatgagtcttcagggaggggaatccattgtgtcagcgaaggatgttgttgaagccattatttattaaggggactcatgaaaaaaatttcttctaggctctatagcaggaatgttttttagttattctgagcaagagatttttttttcccttttggacattgactaactgactgtgttccccttttgtgggagatgggcagtgccacattttcaaacctcttgatccaggtatatggcaggtcttggggtatgaccctgttcctggcatcatcttatctgttctgcctggattttcctatgttcttctcacctcttctttttatataattggcctttccgggtattaaagtaatataacatttataaaatgtagaaaattataaagaacaaaaattacttgtgttccctatgatgaaagataaccactgttaatatactgatgttgtttttcatacatttatatattcaatttattttctctatgcatctgtaattctctgtatatgtctctatctattcatgtattccaaatgtccttgaataactagttaaattttgttccaatgcctattcaatagagtgggagaactgatgacctcctcagtttatgttaatttccagggggttataatcccatgcttttctctgtctccagttgttcagtttgtgagtatcatctccctgtgggtgccatgtctctactgaatgtcaatgatgagtccaggctcagtcctgtcattaaatttcaagagaaagccactcaggccaagcctttgttgagtctcgttgcatatcctaaagattaagtggtcaaaagttttctgaaattaactagagtggtttctttctcttatctcaccagctgcttctgcttctattcctgttcttttctccttgccacccccaaaccctgtcagagggaatcaaatccctcttcttgccttctgcatggtatgttgttgacctcatcccttgtctccaggaatctgagggcttctaggttccctggagttctgatggaaggcttgagcctttggaattaaagaaagatcttaagtcaaaccagagctaccaatcaaggtgctcctaggtctgacatgcgctcacactccaggtctagccacacaggaaggccaggctaggatccacctggacagccaacagacacataaagagagctgtgccagtatcatcagtctctctccaggacggcagcacatagggtgggatgtccctctctgctaacgttgatccttagcatcactgtgagaacccaagacttgaagcacccaaaatagcttagcttcaagttcaggggtactatggaggtgtcaaggaagataagagatatttaagcatatttccatggaaatatgacaactgtatgctgttaagtgagaagaagcaggtctcagagtatatactggttgatgccacttacgtagaatatgtttatgcatagaaaggtctggaatggcataaaaatgttaacaggtacctttgagaagtgggaactttcaccttttgccttaaataattttatattgagtcctttcaagtgagtatgtgctacttttatcataacactttaaaagcaatttccattttggggaaagatgatatgcccccaaatatttttttttaaagtgggagttatgtgagatttttttccttctttctaattttctttctccagtgtcgtattacatttgtggccaaagcataaatgtagcaggcagactacgtgagattaacatgaccaaggacaaagtgacaagataactagccggctggacaccaggttccccatgtcatacccaagctgggaatcacatgttctctagactctgtggcctgggaggcctagtgagccatgtatctaggttcctcaggcagaagaaccctgccagggttcccaagactgcaagagaacaaggtgaaccctgcgctccacccctgcggcttgtgtttccagctcaggcttatatctggacacatacaaagaacttgggaactagtaaactccaaggagtcaggttctagttatttcttctgctcatccagaagaaaatagaggacatatgcatccaactgagaggttggcagcctcatgtcccagtttgagtactggtttgtcccagttccttttgggctcatatctgttcccctctaataacaacagcattaaaaacagtgcttgcctaattttagcatgtattataatcacctggggcacttgctgaacatatagaatcctagctcctatcctggacctattgaatcaggctctacacgttgagaagtttccctggtgtaatggtgtaggtgacccatggattgcactctgagattagagagttaacgggtgcatcaggaaccactggtttcatacctaagctcagcagtgttttattttattttattttattttatttttgagacaggatatcactctgttgcccagggtggactgcagtggcgcagtctcagcttgctgcagcctcaacttcctaggctcaggcaatccactcacctcagcctcctgagtaactgggactacaggtgtgtgccaccatgcctggctaatttgtttgaactttttgtggagataaggtctcattatgttgcccaggctggtcttgaactcctgggcctaagtgatctcccactttggtcttccaaagtgctgagataacaggtgtaagccaccatgcctggccaacttcagcatttactggaaaattgagaggaggggtctatgtcaagaagtagaatccctgccccttgattctgagtattccatgtaactagctctgtccaaggggatgttgcagatatgattcaagcaaaggcctagcaaaatatatatgtgattggactttctctctctcatgctcctgctattatcatgaggagcatatgcacaggctaccttgttggtcccaggaggaggatgaaaaaataaggcgcaaggctgtaacagctcatgtgccccagccaagccttgcctagaatagagcccttagccaacacatgaatgagcctagctgagattagctgagctcagcttagatcagagagtcttagctggctgctatcaaatatttttctttcaagttactgagttttgggttgtttattatgcagccatagctagctgatacatttaggcagctcgttaccaaggcagaccctgaaattgtgattctctgggcttaggaatctgtatgtttaacaaagttcccagtgattctcatgccactgctctatgaaccacacttgagaaacaccactttacactcaacccttttactagctcaatgtgcagtcatggaaaatcccttgatgtttctgagcctcaactttttcgtctgcaaagagggaataatatgtatttcctgtgatgtaaggattaacttaaatataaagaaacctagctgataattttttctcctcctccttcaacttgtccccacctcatccctacccaacctcaggaagacaccagtacgaatatcttaggaaaacatgaatctcagggtcacagctttattgtatagattttttaacacagccatgttacaaacattgtcagggaacatttacaagaataaataagatggacttgcaggtgtaaaaagattacacttcactgtaatgtacagtcaaaaaatatatctgatattcattgacctgacattatttaccttctgcttttctgagctagaattgaaaagaaaaaaaaaacattgacagcacagtgctggcttttttaaaaagttgatttattttgttttctcttctcatacgtgctttatctatcaaacacccaaactgtacaagtgcaggccattgggattcatggaggaggctgcaaagagtgtggagactttggtctcatgcaatattatatgcccagtggatgtgaagatgtcagcctccctggagttgagcgggaaccttgggatagcttgtgagggtgtccagaagccaaggcaatggtagaggccacaactctttgtctttgattggctagtagaatgtagggtgaaaagtgcttttgagtatgattaccaatatgggttaacccggatttacatgggctagctcaggatccacctggtgatgaaatgtgtgcactggaaatgattataatcatgtgtaaattgagttactgtgcttttgcttttgcagtgtgctccaacaggccttgaatagggagtggggtagaaataacctctggagataatgtgtatggtaagaaaagccctgctctgtgtcctacttggaccttcactggttctggctgtcactcatggccctgttggtcagtgggtctgagttatggctgctctcatgagagatctacatgggtattgggtctatggcaaagcagctgttccctatggtttgctgtttggtgataaccagcctggatcagcccagtatatgtggccacaacagcatgttggcctgctcagtgggggcacttgggtgggagagcagggggcttcagcctgtacagaccaaacacaatctacttggattcgtgctctacaggtatgaatgagttcaaacatgatcccagctccacaagatctcacccatctggaatggaagtgacctgaaatccatttcaccaatgcttctcttccctttaaagagacacctgccttcttttagacagctgctgagatgggcagcttatcctctctggcagacagcaggttcttccttacagctattaagtttcactcatgggtcctagttatactcagaggagtgacctgggtctagcaaactgtgcttgacttcatccaagaatctgcagagctatggaagatatggacaccatattctgcctgacccctcagaagcctaactttacatggaatgacaccactctgccctctaagcctccagactgccctggggcctttgacccaaagaacacctgacattattcatcttccatgggagatacagggacagggtggacactgagagtttgttggaccatcatagagaaggcccactgatttgtattcataagcccaaaggcactgaagtaattgtacagagactcaattttgtaattttggtggtttacttcctatgaccctttctcctccacatccaagagtcctgctcactaaggaaccatgaactacattaattaccctgagctccaggcttttatactgatacttttctgtccaacacttcaaggccaccagacactcattctccgaacattccaattaaggatcagagtccacatctcaccacccagagcagttctcagatatagaaggaagccccataatgatcaagcccctaaaactcttcccaatagattttctttcatcctgagcccttgcacttcccttgtatctgccccagtggaccacccctgagctcttagataggtgggatgctaggtttggaggctaccattgtgagtgttgatgcctccttttagagacctaacattcatgagtggatttcagttggtgaatgccctttgatgaccttttcccatctcttctggaggtgggcaggtgggatgcaaaagactggcttgatctctacaagacatctctatagtcagtgccatgcaaaagcccatccctggttactaaaaaactagaagagtctgctcatgtgcacaaatatggcttagatatctctgctgtgcttcggaggatcagatccatgatcctgaaaaatgtgtcagaagaaactggagctagaacagctccccccacactccaccactaacctctctccctgctgttcagtctatgacctcaaaggcagatccctgcaagacaaagccaaggccttgcattctatcacttctagacatgtatacatggaaaacctccaacagggaaactttgcatgggaggagtaaacaaatctgaatctcagcttgtctcttctagttggatttacttttcctatttccttgttttacttggctgtgatttgaagctggtcacaggctaagaaggagctcagactgttaagtaatggggaagccaagtcagggatttgagatgacatgactatccacgtttatgttttttttcttctaacctaccctccagttgggttgaccatttttttccctggggatcctggcccagcacaacctgttgacatgacttaggaacagcgtcctgttcatgcttcctcttgggctcacccatgtcttccagagtgttactcctggttgagcttggtgctgatgacctgtttacccagcccaggagtggcaagctgcagcctaaggaagggtggctttcttcattttgtcccaaggcagtgaggtaccaaggaattatcatttccttcaatgtctctggatctgggttgggcagtcactcctgcagaggtaacaggataagggcctggctgctactccctgggcctcacttctgttgtgtagagcagtcttactggactgatacctctatgtactctaaggggttcccaccagcgacgaggaaatgtagatcctggtgaggacttacagcaagagctagtgtggcaatggggagtggaggatgaataaacatgatgggtcagagggaaatgcatcatcttttgccccagacactgagatttgcccttgttccaagtggctctggcaagctgttacccatcctttctccagctatgtcacagaagtgaccattttgctaaataagtcatctgcatcctcggttctgagtattcactgggttccagtttcctggccttgcgttcctgttttcctgcctaaagtgctccaaatctaccccttctaatgttgatgagggtccttttttcatgtatgtttttcatgtatgtatgttttcgttcaaactaaagactgagctctgtccaccacaaccccatgccttacccaggaattaattgtgccatagtaatctcgatttcctaatagtgccccctccaaggtgctaggtgctgtaggcacccagtaattatgtgtggctagggtaaagtgaggagccttccagaccccagctgctcatgaagtgtgtcctcagacttgcccacattagcaaccatgtgactccacttggacaacaggcaccactttccagcctagcattcaggaatctgctgagtacagctgtgtccagcttctcttttccctttagggttttgtgggctcatccttctccacgccagatgagcaaatcctcatcattctagtgtgagttaatgggttccttccagcacccaactggaagatgccttagttgaggtcccctcatgaacagtgaggtcagagcacccacacaccaaaggagctgcctaggagaaggtcagttggtcttgatcttgagcctataactggctctgggaggcagcagggtcactgctcctagagtcaattctagggtcaagctgaagaccagctgacctagggtccgtcatagcggggtgaacagaacagaacaacatgaggaacagagcacatttttttttgaaatattcatagagtcatattaaaaccaacaaggctaaatcagaaagtggaatgcaaattttgcatgaattgtgaacgtaaaacatgagactatgaaggaattttaagcttactgttgtttgctttgagctttatccactgacgtatctgttccactctagtctcttctgttatgggtaacctcctgggaaaaatgtgagatacaatggtggaaaaatattgtctctgtagtgagaaaaaaccggtttaaatcctggttcattcactcactagctgtggaactgtgggcaagtgatttctcccctaggagccttagtttcctcatcagtaaatggtgacaatcacaaaccctcctttagaatgctggaagaatttaatgagctcacatgttagagtccccagcatagggtctgttggttcctttgcaggccacacccacagagagggccagcactaaaagcaaactgtccccttccattcccacaaagagaggcctactgtggccttctagaggcccaaggacccctggttggcccagattcttcaccccagaaaggatgcaatgttggagtgcagctaagatacatcctgaagctatttaggccataaacacaggtggagaaatttcctgggcttctcattacttccttgcatcttccccaaacagagcccacatctatgaggtaagagctcctgttgtaaagactcagagagcattaataatattttcctctgctcatgacaggctgagctcaccctgtaaatggggtggggtggggagaccccctgggggtggtggtgttggctccggagatttcctgggtaaaggaaaatgttcaaattcctgggcactggtgccccatctcatccaagccttgccacatccttgtcccatgggatcttagggaagtcatccccatccataagcctcaatttcttcctgtgtgcactggcctaagacctattcactgtcctgctttagagaatggttgggttgtgggaaaataaggggatgagctgggggaaatcatcactggcccttgctgggttaccccaacatggcctgagattttttttttttgcaagtttgtttctccctgaagtcacaccttaaattcctaccatttaaaatgataaaagccactgtcttttgtatctgccagctatttcaccccttcctgagcagaaaaaaatcttaggatttgtgttaaatagctctccctccaccctcatcctgtctggatgtaccaagatctaagaaaatagcatacagcaggcagatttgccatgctacaggctccttgcaggctggggaaggccagctggggcattgggctggagccgagggaggccagcaggcccagtgggggtgggtccccggggtctgctgaaatacacctggggagaggctcatcaaaggaaaagagcaagttcatcgtggggttcctttgcttgcctttgctttgaggcacttccttttgaacctctaaagtgacagcccttccttgatcaagtctggtgtccctggacttctggacagctccagagcccatgccaatggaagcaacttttgtcggctcctttcatgttccatcctcatgggcctggagatctgggttggtgaccctgctccgtggtaaagcagagaccctgggtttctcatagaatctgagtctcatgatccattgcatatttagttccagcaacaaaacaatgagcagacagacaaatagatgtgatattaaaaagtgcacgcttaagggaatgttttcacagtgtctgatgaaaggaaaagaggcagccccattggcccagaaggagtcttggccaacacgaagctgagtgcatctctctaaagctccatggactccttgttgccaataggacaaagtctgtactcgcgatgggcatctgtctcctggaccctggctcatctcttgctgctccccgtgttgtgctgtgcccgcactgggctggcctcccccagactgcttctcccaatgccttttcacatttctttgccattgcacatatggatccctttgcctgagtttcctttttttcctttttatgcttgttaagacccagcaggaatggacgtccccttctccaggaagcccgaggccgaagagactttcttgctcctaggctcatggaacactcatccactccacactactgcaccatggttccatttccccagcatacagtgggctcttgagggccaaagctgtaccttcttgaattctctgcccctcatgccctgtctggggctagaccagccttcaagatggagcttcctaggtcccagcccacctgaggctgtcagatattgggcctaagcactggctagagatcaaggtcgagagtttccctggctggtccattcatagcctgaaggaacagggaattgtttttactgactaagaaattagatgagactggctttcctggggagctgggaatgtgttactaaaatatatctgaaattctgcgcttcccagaagaactggcatcaggaagaaagtactaaatttccatttgtggagttatctgctcagaagtttctggccttattttccctccataaaataattgcttggcttagagaagatgaagaaaacagcacggagaagtctcattgccattacctgcccctttggaacccaggatttcattactaaggaaggtgcgtgggtttcctcattggaggagatgatcaaatggagatgataacaagtcagtagctctctcctgggggttctaaggactgtgtgaaatgtcctatggaaagtgccaagcatgatccctggcatacagtagagacttagcaaatgttggttccctctcattgactcactcacactttggacaagaccctagatctccaggcctgattctcttggcctattttaaatcaaagtataatgggctccacaatggcctttttcaaggtggctgctgggtttctttaggaaggagttcaaatttggacatccaaattatgcacaaagctggtgctctatttgccccagaaaccaaagggaccatcttcaggctcacccatctctccttgctcagtggcatgctgtcccagggtgggagcttttaaggacattgccaggaaaaaataaaaggcccgagagatttgtcttagaggtacatactcaaactcccccgcccccttctttttgacataagagactaagattttacaccctccaaaagaaagtttcttttcacatacactttggaaaataatcaaatcttatcttgtttgtctcttccaaagaaagctaccaccaaagaaacacaggggttacatcctacaggtcagcccaagccctgccccagggaggtggtccctttttacaaagacaaggaggagcagagaagttccctgcagttccaccccctcccactgaccacacaaaaaagcaaagaacacctttatcaaaaactgctgtggacacagctggccggccagtgaatgctggacggtcaaggcccaggctggggaaggggtacagaatggttgtgggcgaagccccatgcaggttaggtgtgaggatggggggcctctcttgtggcctagggaacatcgtaaggtcacactggtccagactgcaaatgtctggtgccagaggcccctgaaggaggttgcagggggcagcagagcagtgacccccaagagcctcaatcttttccatgacgtagaggagcagaacacacatctcctccactcctaaggagaaggagggcaggggagcctcccactccccagcacctgcacagttggcttgccaagagatccacaaactcagaacaaaagcaggtggtctgggagccagaaatccaaggccttgcttgtgggtgtacttctgcttgggcccttggctgtggctggttaggttgaaaaggaagcctgggccttttggagcagcatctcccacggcaacaggagacccctcagaaggtgcagagccccccgtggaacacagggccaccagtcttctccttggagtcaggcagggtgccacctcagagctcctgagcccagttactgccattcacacaaaagggggcttggtcacagcagcctctggactccggcaggttccccatcccattgagctaaaaggagcttaaatattccagtgccacctcgtatacaaatttatactgttcctgagaggcggagaggagcagaggcagagagggagaagaggagacgagagagatgaaaaaggaaagggaaaatgcatttagtttagagatacagattttggagaaaactttttctatatccatattatgtcaactcaaaattacccatatctggacatccttcaaaattctgcttgatgcctgcttctacccaagcttcctcgaatgcccagctggcatcattccctttcttttttactgttttgtacaacagggcttctcaaactgtaacgtgcatacaaggcagccagaaatctttttaaaatgcacattctgattcagtaaatctggagtggggctcaagattctgcatttctaacaagctcccagataatgatgctgctgctggtctgtgacccacacgttaatatggcctcattttgactaagaccactattcgagtaggtttaaagacttatattaaagctcctcgtgcatggtgcggtggtccaccatggtaccaggtcttatcacccggggctctgcccacacactctctttatcacactttcctccatagtactctctactataaatgctctctattgtaaaaattaccataaattaattggaatataattggactgaattgaaaacatacttcacattctactaatccagcatcctttcctttaggcctgaattaatgacactgtcttaaggaatgggcagaaagtgaagcaaagtaggtgtaccaggattagtaattggattttcctgcaagaaagaaaagttggggaggttggaaggggaagacacaggacagacaacagtgcataccaagggcacagaatgcaggtatacaattagcagccaggtgttgagtgatgttactatttgatgtcattttctccaggtcaagggaactagtcagccctggctgttggagaacagtccttgggatactcaccagggtctccaccatgttggatttgttgttacgcagtgttttcacgatgtggaacacgtcaatgatgttttgctgctggatcatctcacacacactgcagatggcacagaaggttccactacggcctcccccatttctaaacacagagcaaagaggtgagccatgttcctaggtcccttccaggcacctgatgattctaaagctacatcagtaggagtagggatcagctgtctgggcagatgcaaggcaaggcaatggtgaaggctttagcctgagccatgagttatggtttgagtcccatctgtgccattaacttgctttgaccttggccaagtcacttcctctgtctgggccccaagttccccacttgtataatgaaggggttggactagatgacctttgagagttcaattagcttgatgttttcttggttctatgagcatgttacagtcactcagggcacactcacccaaaccccaagggcaggatggtactgtgtctttgtacatgtgacacctgcatccttgctgatgcttgcatccatgtccaaaagaatgctctgggtccacttaaacatccaataaagacaatgaaaatttccaagtgattttcctactagttcttcccatcctccactaaggacagcaatgctctgttagcctagggtcagccagcccaagcttggaggtaggaacttggagggaggaactggtcctgataggctttatcttaaaatgacaggtctctactatacactttggtttaagcaagatgctactgatcttgagtctagggatacagggttggtggcagaactgtgtctctgttactcctttctgaaactccataaatcatcttcatggaaacacccttcaaactctttacagacagtccctgtaggaatatgcctgattcagaactcctgggcgtgttgccaagagcaactaatgatttcatgtaatggtctgtgtctaaagaacatctggacagaaactaaggcactcagtcaatctcccagatgttttatctacaggacatgcagtgaccagatgtttcaagtacagagagttgctttccattcactgactggtgcctgcatttcaaggtctgttatggtgtctgtggccctcaaggaaaccaagttccctgttggtaaaagaatgcccctgtaccttcctttggctcaaactactggccaccttggctggaaaggacatagataaaaagacactagtgcaaaaaaaaaaaaaaaaaagcaggctaaaaaacaaacatgagagagagagagaggagagaaaggtctcctatgaaagacggttctatcatttctgaagcaagaataacagcgtccaaaaggaagaggtgagtagacacagggtctcagggcctggtggtgtgagaccctgaaagatgggtgctaaggtaaggtcacctgaatgtgtgggaggcatctgggcatctggaggcagcagctattagctggcaggaaaccagctgctagtttctgggatgtgggcagagccagctgggcttggctgatgtcacccatcagcctgacttgggacactacgcagcatcttcctgaactctagcctgaggtttgcttcctctggagaagaatttttgctgcaggtggtggccctgaagctctgtgtgtgcatctctatgtgtctgtgtgtttaacctcctttaagctctttgacttgcctaacatgtgcatgcaccacctgtttgagagggagaataattagctggttttgaaaagactgacctcaattctgaggtcagtcagatgttatcagtgcctccactagctccagaaatatttgttgtaagaaagagaagaccttcgttcaaatttcctttaacataacattttaaaagagagaggccttctcaatgacttttcctcaaatcgttgaagttctaagaagcaaagtgagtgtgaatcaaatatttcacacatagctgttatggctgcagatttgttttgggtgtgagactttgtagaatcctctgtggtcactctatactcccaggatagattctgtgacacttgctcttttaagtaattacatttacgtttgcatatttgctaccatgacattcttggtctctatgttggcagataaagtgtgttcactttctatttcatgccaaagcactataaggtctgaagattgtctaattccacatacccaatgaacagacgaggaaactcaggcttataaaattcagtgattttcttgacgttgcacagcttgtcagccactgtcctctcgaggtcctgacctccacccagcgtaatgacaccagaattcattagactggacaatgtccattcgaagacaggaggtaaagtctccagttcaccccagcaatgggggtataaacacagctggtctggagctcactgtgcccctgcacaatagtgttcctagagtccttcacatccatctatcagcccctgagggcagtgcctttccctcatgctctttttgtcctatgatccctttaagcccattgtagagaagcaggcaacctcctctcatgtttgtggaaagaccactaggttttgcatcaataatatgtcatatattagttcaggacaacaaactggcagccccgttccattaaaggatcataattcctttgaatgtactgccactagcctttgagggatgttgagttgtggtatagccaggcctgcctaggactggggtatgtggccagcagcatctgcaaggatgctctatcacccaccaccctattgccctggtgacacctccctagtactcacaggcagtggaccacagtacgtccctccctcccgtcatactgctcctgccacttctccagtcgtcggaccactttgagcagagagcgcttggaggggggcgtgtcccggtaggcaggccagccaatgtactggaggtgctggactatacgataaccatcctgtggctgagaacagagaggctgttagggctgttctgctggggatgcttgcgtacatgcaccttgcagataccccggggactgcagcatcatggtggaagacagaccaaatgggatctaagccatgtcctcacggggagagtccccatgactacttctattccttcgtgtacacagattctcttgccgtgactgccctgaacccccttttgtacctgaaaaactcctgctcagccttcaaaacccaatttaaatgtccctttctttaggaaagccttccctgactctgttgggcagagttttttctccctgaggctcatgtgccagaacatgtctcactgtctcagtggacagtgaactctgagcaggggggtaggggaggtgctgagctcctttcatcctgggccccaagtagtgaccaaagctgcattagttagcaaccatttcatagattgctaatctgcccctcccacccactactctgctcagccagtgaacatcctcatggaagtaagtaatcacttttcatctaggtgttggcagtgcctggcccaaagcttatgggatccaatcaaaggctgcatcaactcatgccagtacagagacacagtggggaagagctaatgtctaagaagttttgtctacacggcagcaagtgtgtcaggaaacaggcagatggcaggttggatgtcgctcgttgcatctctatgtgttggagtcattgctgagtctggagccggaatcagcacaggcatcacttcctcaaggaagaaattatcaggagagcacaacacagactcttggctggctcagcgggatcctctctcggcagcctccatctgtcttggggaggaggggctcagcaagcaatggcggccgtgtacttacccgggccatgttacagatgcggaatattctgtggatgatgtcctcgtcgatgtctgcggagacgaactccacctggatgggcccatagcacccggaggtcttctcaggccagtactgcatacagaactgagataaggaaagaggtcacagaaggagctcaaaggcagggggcgggtatcaaagtctcatttatcaacaagcttttcttttctttttttctttttcttttttttttttgagatggagcatcactcttgttgcccagcctggagtgcattggcacgattttggctcactgcaacctctgcctcccaggttcaagtgattctcctgcctcagcctcccaagtagctgggattataggcacctgccaccatgtctggctatttttagtaaagatggggtttcgccgtgttggccaggctagtcttgaactcctgacctcgggtgatccacctgtcccagcctcccagagtgctaggattataggtgtgagccactgtgcccagccgtcaccaagctttttttatggctggaaggacacattggccagaaaggtagagtattatgtaggaaattagactcagtttcccctttagggagcagccatccactttttctggtgttgaaatatcaaggctttgagcacagaaacactgggcttgcaaatctttgctatgttgatttcaaaccatttgttaggtttgcttaacctgagtttcctcatctgtaaaatggggagaataatatctacctctaagccccgctgtcaggattagatagaacatgctaaagaaagggcaagtaccatctatttttcttttcaccacgcaaatcatcacaagctcttcctcattccaggaaaaccttcatagtgttcattcatgatcagatcagaagtagtgtaaaaaatataggggtttcgggaggcggagcttgcagtgagctgagatcgcgccactgcactccagcctgggtgacacagcgagactccatctcaaaaaaaaaaaaaaaaaaaaaaaaaaaatatatatatatatgggtttgacctcaggcggccttgggtccaaatctggtctcaggtgctcactagctgtgcagcccaggcctcagttttctcataggtaaagtggggataattatgcttactttgcaccaaaagttaatgtcacatggtgctgacagatcttgcctatgattctttctatttatctggaattggaaattagaacctacagctgagagcaaaaggcagtgattgaccttctgtttaagacagtggttctcagtctgagactgttttgtttcccagagggcatctgggcaatgtctgaagacattttgattgtcacacctgcgggttgctatgggcatttagtgagtagaggagaggatgctactcaacatcctgcagtgcacagattagctccccccgagagttatgtggccccaaatatccatagtgcagagactgagaaaacctagtataaaatcattataattattattattattatttttgagacggagtctcactctgttacctaggcgggagtgcagtggtgcgatcttggcttgctgcaacctctgcctcccgggttcaagtggttctcctgcctcagcctcccaagtagttgtgactacaggcatgtgccatcacacccggctattttattttttttatttttattttgtgtttttagtagagacagagcctcaccgtgttagccaggatggtcttgatctcctgacctcgtgatccacccaccttggcctcccaaagtgccgggattacaggtgtgagccactgcacctggccataaattattctttaagcttcaggggtcattgagaagaagagatggaggctgggtgcggtggcttacgcctgtaatcccagcactttgggaggccaaggtgggtggatcgtgaggtcaggagttcgagaccagcttggccaagatggtgaaacccgtctccactaaaaatacaaaaattagccgggtatggtggtgggcacctgtaatcccagctactcaggaggctgaggcaggagaatcacttgaacccagggggcagaggttgtagtgggtggagatcacgccactgtactccaacctgggaaacagagcaagactccatttcaaaaaaaaaaaaaaaaaaaaaaatagaagaagaagaagagatggatatcttgtttcttgtatctttgtctctgttaagccactagataactttagctgaggagagaatgttgaggtggggggtggggtgtgtggctgcagagaggagcaaggcatgctccctccagttcctggttcccaaggggcacaagatggatcctgcctaggtctacaggtcccattgctggggtacagaggggagacaagattgcggctgcaggctcgctggggaccaccccaacatgaacaaagaagtcatgtgttagacccttcatctgggggttaccctgaagatatagccaagattcacaaagaaagacccaccgaggcttctgagagcagtttgggattgagtctctcctcagcgggggtctggttcaggctaccccaggcttgcaaatagggggctagatggacagaagtgacccaccccctacagatgcagggttttcatcgaagggggtgcttgctctccacttcgtggccgaagaacagccatctcaccctgagaagtcacatgtgaaaataccttcattctctccttcctccagaactagaattagaagggaagagcagcgagcaggaaggatgtaggagatggaaactcatgtctcccaccttcttagctgtggaaaccccaagttctagcttaggaatattcaccttatagcagcagttggcatactattgcccacaagccaacccagccagctgcctatttttgcatataaagctttgctgaaacacagctacacttattcatttatgtattgtccacagttgctttcatgcatcacccacagagttgggtagttgtaacaaagaccatatagcctgcaaaacctgaaatatttcctatctggctctttacagaaaaagtttggcaacccctactttatagggttgttctgaggataaaggacataattcatgtaaataaacccttaccacagtgccaggcatggaataagcatttactaaattccagtgattcataccattgttgaatccatcagtgctcaacaaaaataataatagtaatagctatgatatataaatttgaaggattcttcttatcgcccctcataaatagcataagtatgcaaggttaagcttcagaacgcaatgatgccttgctttcctggcgtctccactgggggttaaccaagcatagtgagaaaggagctctgagtgtgtgtgagtgtgtgtgtgtgtgtgtgtgtcttgtcgggcgctggtcacgggcctccatggctggacaaccatctgctgagctgtgcaatgatgacaaatccacaatttgaacttcatttctctttgccattggctcttccgccttgcaaccttcacagtaatgagagattggtacaaataagtctatggttggtcagagaaaccagaattaatcagaactgcccattaaaaaaaataattgcctttatcacctgcactgaatttagggttcctagagtttggctgtgatcctgacacaaggtgcatggatccaaggtatcagggaagtcctattatccccaatatcttcagtctggagagaatgtggaatgatttgtctcttttaataagatttccagaccaatttctcaagctgatagattctactacgcctcaaacaagactcctatatttcgggacacttctctgcattcgattttctgggtcactctctcataatgcccagagggctggggaaggttgcaggcttttctaatcctaaatcagagtcatcctttcacttggatgccctaatttgtgagactacagcagcagcagaatgggtgaattcagcagggtgatgtgctggcaaatgtggtgtttgagctgccagggatcatcagggtctctctgcagcccgggacactgcatatattctagccatgggaaataagagaaagaaagcaggggggccatgttttctcttcccactgaccctttggggctcagaaatgactctcatcaataagaaacatcctctgtggtttagctcaagactgtcctggtgttcaagtgctgtagctgcacctgaatggatgctaccattttggtttgcttatgttgtgtagcaaaaggtgcgaaaatgcattggggtttcttcttgaagctccctggattcaaatcgtggctctatcactttctagtttgaatggcttggctacatctcttagcttctccagtttgttatgagtggctgtgaattttaatgtctacttagcatagggatctgtatctagcaagtactcaattaatgtaagctgtgattattaggcagtatgggggagggttcctcaaaccaagatggataaatagatgatttttttcctccacttagtagcttttatgaaaatttctctttaggataatactcaaaggactgcccgtgtggaaattctggatcagccagcttggggtagctgtgaagatgagtagcatcctagatatgggatactgcatgtcaaaatacagagatctgtgggttgctccgatgagctgaatgacccagaagataaaagaggaaggttgagatcactgtagaagcagtgaggtataaaaggcaactcagtgtgtcacataaccctgctcctaaactctgaaatatgccataaactcataatagcatgtaaaatgcatactgtgcatgtatttcttgcagaaaccagcaagaaactgagctcggctccctggctcacatagacatggaacagagatcacatctgtgagtggaggagccagacttttcatataagcacgtaagcatctgcgatttatacaactcctggggagggaaagcttatggtttcttaaggctcaggaaatgggaattctaggaagcctacttgcctctttaagatcacgaggacgtagctgacctaaaggccacacttaccctgaatgcaaccttgacattttcttccttagatgtaaaacttttgaagttggctgatccaagaatagattcaaattcttcagccaagagtctagaccaactgactttttccacttcattgcctagtaagtactctctcctaccctttcttttccagtggtctgagggtgaaaggtgatactgcctgaagggagggctttgccactgcagatacatacaggtagtggcgatgaacacaccggggagaggaagtcagtccagttgttgttaatgatttagaaataatcatgcttcttccaaaaaaacagaggggacttttgttgtcttttgtcagaacaagttaaaccaagcaaaggttgtgaagcctgtgtggatagccctggaacagctgccatacattattccacctagtgctctccatggctgtttgggccatgaaaagatgtccttggggggtgcaagttcacgtgtgatatataacaaatgcagaggtagcctcacgcattaaacgtctttttcttgctgatggaatcagaaagcttgttatcactggaataaacatgctccgatgagttgaatgaaaactagcatatgggtctatttttggaataaacatttttagagcatatttcagtgcaccttagttatgcctttcttttattaaaaatactttgataaaatggaaaggccaagtaatatcatcacgttagaaataaaggactttatttattaaggcccctgcgacccagagtgaagaaatcaatcccaggccacctaaaggtgaagtgaattggtattttaaagagagaaatgtaagtttcctgaattgcttttaaaattcagcatcagtgattataaaattcctttaaacagattctataaagatccaaaaatatataattggctttgatactatgtccagttaaggaaggcagactgtgaatgaaggcataaagaagacagggacagagggagaaagagagggagagagaggggggagagagagagagattcacacatctctcctcattgtatccttccagtagtcccatgaagctccataatacaatctccacatagtgggtggaaacttactcttaaaacagctgcatcagagtttgtttcagggaaggaagggttggagtttaggaacttacctacagaagagtcttggggtgggaggcaaggctcagagcaggtttaagaaagacgtactaaggagatggctagattttgcagcttaagaaaggaacaacttttggggagagggtggaagagctgagaagggagggatgggaaaggaggtaaatgggaagaaaatggtttgggcaacagggtcaggggaagatgtgttactgctagtgagagctgaggaggcaaggtgaggcttcagaaagaggatgtgtgatgttcaacttgaagtcatgggcattgctgggatatgaagctcatatctctccgactaaagcctcagctgaaacttggaagtaaacatgagaagacaaccccctcagaattctcagaaatgttggggatggacattgggttttcccataggatggggagtagggaacagagcaaattttatttaaatcttcaaagacagaatgaacttggctaacatctaggttatagtaatctaacaaatgataacattaagacttggagaaagtaaaggaactggctcagggcaacacagtgagtaagtaccaaggctacaatttgaactcaggtctcttgaccccaggtttcttttttactgttacccctaccattctggtggggacagaaacagagacacagccccttgcaaagtcagacctgaggctggctgagatgcaggttgggtattttgcatattttgctggtgtgttaggctgtgttttcacaagcccagactaaaaatggggatattaggagttgctatttgccctagaggcacaatggcagcaagagacatctctgaaatagcaccctgcttttctcctgggagaatgaggagcttgcctctctcacttccatgggaatccatcacagcccccattatccttgcactcaggcaccctcacctttccaaaaggctttgcatccctgatctctcaggctttccacagtgggagccccagaacagagcaactcagcttttatgtaagttgtggactcttatttgttttaaaggaaagaaacatccttgtatgctccatacaccaggtgccatagcacattcataggtctcaggggttaggatgtggacatctctggtggggccacgattctggctaccacacagccccaccctttggctggcatgcaggatctcctgagctctctaaacagtatggtgagtatggcatgactgcaaggagggcttctttctggtgtctttctggtggtccgtagagaccacaaagagggaaaagatcttgtcaatgctgttggatgtggttgaaaatgttctttctgctgagtctgagaagtgacagcatgctttgctggctggcgtggttctaggattttaccccgcaaatctgaccacagacatttggagtcctaaagagttagaaaaatctgtaaggttgaatgcagaagtttgaatgcctttattttgagccctcattgatcataattacctttgaacagcaaccactgcaggaatgaaagaaaatttggggctgactaaatgaagtagtgtaagattctgagcaggggcagatttggccagcagtgcaaaaaaaataaggccctgtgagagcttacaccctcttcttattttgctgcagcttacaggtagccctgcccaatccccaacgtacgctcttatggttcccaggcaaaccacaggagatggcatcggtcctctcaggagtgacctagcaatgctcaggtcctaaggcagacctgtccatgttgccaggctgggctagcttggaggctgccttggcatgagcacgcaggcagacagatgctgacgccgcttcaaagaaccgcccctccaggtgctgagggcggcttttctgatgctcatcctgtgtcattgtttattttcataaggcgcccagctgctgcggtgatgatatttatatcaataagtgctctattcatctgccggtttcagggaatgcttgccagctgcgtatggcagccaacctcagggtacttctgagcctgatgtttttgcatttagagaatcagttctcaaactctgtaccaacatctgggcctgaaagattcttcattcacccaggacccaccctgaaagggggagctatagccaatgaccttgacctttgtttcaaaggttttatatgtcccgaagtgaagttctttgaaagtcatcctctgtgcctgagctctggttttgcagaaagggatgttgaaaaagagaagagcaaacagggttttgcaggccagacttcatgcccaggctcatgagctgagttcattcttttatttcttcagccaaaagcgtagggtggtgatgccttcagactccaaaactctgcagggaatgttccagaactctctgttttatgagaattcatttattttttatagttatctcagtttctaaccttctattgctcaggccccaatcattgacattatccttcattcctctttctttttttgacagggtcttactctgtcgccctaggctagagtactgtggtgtgatcacagttctccacagctttgatctcctgggctcaagtgatcctcctgcctcagcctcccaagtagctaggattacaggcatggaccaccatgcccagttcatttaaaattattttgtaggactgggtgcagtggctcatgcctataaccccagcactttgggaggccaagatcagcagatcacctgagatcaggagatcaagaccagtctggccaacattgggaaaccccatctctactaaacatacaaaaattagctggctgtggtggctcacccctgtaatcccagctacttgggaggctgaggcaggagaatcgcttgaacccaggaggcggcagagttgagatcgcgccactgcactccagcctgggcgacagagtgagactccatctcaaaataaaaattcttttgtagagacagggtgtcactgtgttgtccaggatggtctttaactcgtggcctcaactcctgacctcaagtgatcctgcttccttggcttctcaaagtgctaggtaagattacaggcatgcctggcccttgattcctctttctctctcttattccatagtcaatctctctggatgtgttgttggctttaccttcagaatctaccccccagttcaaccaacctcacctgccacctgaattatcacagtagtctcttgtctgttctctctgcttccatttcagaaaccactcttccccatccttgcaccaacaatctattctcaacacagcagccagagggatgcttttattaaaaaaggcaaattatgttgctcctctgcttcaaacatgtgcatggctctctgtttctctgagagtgaaagcccaagttcttctatgtcttccatggccctctgacctcaccttctgctgctttccccacagttgtgctgctctgcccatggcctctgtgctgttcctcaagggcaccaggtgcatgcctaccctgcagcctgggtgcaggtgttccctctgcctgtgatgcccccctgagagtcacatggctcactctctcacctccttcacgtctgtgttcaaatgtgttcttctccatagggcccaccttgacaatcctattgcaatgacattctatgtcccagatccaacgttctgatctttactaccctgccttcttgtttgcctttttccaaacactcgtgtcagccttctaacttataattgagcacattagagaatgtgtgttgcttattatctgtctcctgctttagaagagaagttgcatgagagatggcaatttttttttatgcctcgctttgtctgtgttgctcagtgatgcattccaagcacctagaatagcttccagcaaatagcagatgcccaacaaatatgggttgcctgaatcaatagactctctccggaacgtctctcacaggcacatcccaaggtgcactcaatttcatcccctgttcatctgctcttctcgctgccttcccctaccttcctgactttcatattttccccagttatatccccagttgcctaattgcccagactcaacttcctgccattatctgcaactttccttcttattcacctcccacctgcacctgctccctaaaccttggggacttaagtctggaaatgttttcacgtccaattccagtcctctcacctcctggccacttctgcagttcagataactacctttattgtctacacatttgcaacattctcctccccggtctcctggtttccaggtctttcctccggccttttacctgcactgatccccagacctggctttctttttattcttaccctttttttgcaatttttattttttttattttttaagagatggggtcagccagatgtggttgctcacgcctgtaatcccagcacttcaggaggccgaggcagggggaacacttgaggtcaagagtttgagaccagcctggccaatatggtgaaaccccatctctactaaaaatacaaaaattagtcgggcatgttggcacacgcctgtaatcccagctacatgggaggctgaggcatgagaatcacttgaacctgggaggcggaggttgcagtcagccaagatcgcaccactgttactccagtcgggatgacacagtaagagtcagtaaaaaaaaaatgggttcttgcactgtcacccaggctggaatgcagtggtgggatcatagctcacttgagccttgcagtgctcaagcaatcctcccgcctcagcctcctgagtaactgggactatagacacatggcaccatgcctggctaattaaaattttttttttttttttttttttttgtagagacagggtctcatggtgttgcccaggctgggcttgaactcttggcctcccaaagtgctgggattacaggcatgagccaccatgcccagcctctagacccatctttctaacaggaaccctggctgtgttataccactgtcaaccctccagtgtttcaccttcctgcacagaaagtatttctaactgtgctcctccaaactccagtggtcccacaaaggactgacccctctaagggcaccaggagaaaatgagacagcagtgtgggtggaagcccaacccctgcctactgcttcatcatgagcagcttttggtcatccctatttcatacattgggcttgcatgaaagcttttattcatagaaaggattctgtcgcttacaaagtagaagtctgaagcttgctatgctgccaaccaagacccaagctccttagcctggcacagggacctctctgcaagctgggctctgctgcatttttcagcctcactacattcttctcctcctgatattcctctaggtcccagccacactggaacataaactgttccgcaaataagtctgtgtatattcatcccctgcctcgcctttgcctctgctgttccctctgcctgaaatgccttttcccagtgagttcagcctccatatgcctaaagctcctctgccttcttcaaggccaaagtcaccttctttttgaagtcttccctcaccctctgggcagaattcattgctccctgctcctggccaacacagcacttcactgctgacctctattataacacagccacatgaggttgggacaatgtgctcatctgtctctggagcaagaccatgcgcttttggagggctgaaactatagctcaggtctgtttaaaaaatttttaaattcccatccaaggcctgcacaaggccagctctcatatgggaattcaatgttactttaagttttatttaaggcagtgaaaggataggtttttaaaaatctgaaggaccattctcagctcttccaccccagaatggctgccctggcatagaaactgttccaagatacacgtcctgtgtcctgagtatggggatatgctgtaggcacgtgatgcttggagctatcagaacagaggggctaaggcaggaagcctgccggggaacaaaggtcaaccgtgaggaactggggcttggtggggtggtcagtgggtaatgtgtccaaggttcaagtcccaggctctgtctgtacaggctgcattgcagagggggaagggaggtgagtgtggccgggcatctgggtatttttcagggctgcaggtgctcagtgctgggggaggaagcctcctggctctgcaagatctgtgtgatttggagcaagacaataatcaatgcttgtgagatggagcaacagagtctggtcccgggcggggagttggacaaagcccataggcagggggagtctttgctggaggtctggggggtgacaggaccctctgtaggtagcagaatggcttgtctgatgctcgtggccagacactgcttattacaagacagctggctggggcagatgtggcaggcaccggctgtcaagggatctccctccaggtttagagcatggcccccctgacccacctagggcttggcttggcctcctcctacctgggcagtgtccatctcattcagcatcaccacagaggagcagttgtaatcgaacaccagcctccagaagtctgccacggtgttgggtagagggtgctgggtgaccacgaaggcggcaggctgcttgtggctctgacaaaggaatgacacaggcttcgtaaattacacatccatcagtgatattctgatgatgatgaggcctggactgaggccagaggctccagagcctgccaaatagattatacaaaacacctgcctgttcttttatctctccacgccctggcggcaaaggggaccttctcataatgaacacaatctcctccaaactaagacatttcattaggaaagtgtcactgggatgggattatccaaataaattatttatgcctcggagctcagcaaataatcataattacaatacgaaatgaaagatttcagatgcagatttgttgctctactggtcaagacacctcttgggatataagggattggccgcatccctgtggccacgatgctgggcgaggttttgggtcggcctgaggccgagattctcccaaaggggcaggctcccttctgcctccaggctggagtgaggggctgagttgccctggcaaggtgggcactgtgtcatgtgagtcaatggggcagtggaaagtacacatgcattattaatagtccggtagacctggggttcaagtacagctttaccacttgtaagttatgagtcatccatctgtccatccatttgcccatttattcattcatccattcatccattcattcaaactttgtagagtgctttttttttggcggggtgggtgctaaatactggcaagttattagatgattccaaagctcatgttcttcacctggaaaacggaaatcataaatccaaaggaatgatgtcacacagattgaatgagatttacgtgtgaaaaggccagcaaacaagagccggaacgtaagcctactggcagggcagaaacacccctgactttgttttacgtccttggcactggtattgtcgctggcacatgctagacagtgccactccagtgaataaaacaataaattcagtcccgtgttgcagatagggaaacagaggcccagagaaaatggcctgggcggggggggggggggtggggtggtctggcagcttcatccagggccctatttattttctccccaccctgaagtcatgtatttgaaaagattgggaagattctccacttcatcagtggctcatgtgcttgatatgttttctcaagagatgatgatggtttctgtgggagttacagctgttttcagtgcagttacaagcaagagggaagagggcaaagaccctggaaaaagcaggacaaagccttgcaaacatggatatcatgcgtgcattggctgggggggcccttcttccgagggccttttcctggccagtagaatgttcagaagaggggtctgggtgggcataggcaaataatttattttccaaaagccaaactctctagctgtagacagcatcaactttgagccatttccagacatggaaaaacattgaggctttgagagttaacagacttggggctccaatccttggctcccatttctgagctacttgaccttgagcaagtgatgaatgaaaatactctgaccccgaggacctcatcagaaaatggggatgagaatacccacatgcaaaatgggacagtgcaagtccagggcccgacatggtgcccaacactcagtgaatgttagttttcttttctttttccctgtctctgtgataaacgctctattaggccagcacgcctgacaaagccttatctgaaaatatgttcgagatccgtgctcctgccgggtttcagggatcagccggcaatccatttcatggataacatcatcctttaccaggggaaacattaaaaattaacccagaggacttcatatttttctgctaggagcaaagctgctatggttaccagataatgcactgactgggctggaatacagataaggacgacttttttttgtttttaatatcagaaaggcaaaggccccagtgatggctcacaggagaaatgccctgtggacaaagagaatacaatcagcatcagagcttggcagaaggcatttgactccaggcagtatctaacctattaagtagaggccaggagcttatttgatctttgcctggatgaggaaggcagggagggggtgttgggagaagtgggagacaaagctaggaggaaattggaagtatgggcgcacccctaggctccatttctcatcacactcacacacataatgcacacctacatgcacacatacacatacatgcgctcattgactttagaaggctctaagctataagctaatgccaaaggtcttctctccacctctagctacttgctatgaccaagccaagactccctgattctgaacccagagctagggtttttacagaggatatgggcactctgtggacagaggccagggcaggcccctagagagctgggataggcattgaccttccatcatcaccctcctgcctctaacacccagacccttgggagaaacttcaagaggattagaggtcagagaagttgttggccttgaccccaggagaaagcatcccatgtttctgtctattctgagtgagataggagggccacatgggctagatggatgtgaactcagatgggctggggaggggaagctggaagggctcattatatcaggcaatggtgttcttggttttgagcctcaggaggtgagatgtttgcctcttattggatccaccaaattgcagggaggctcaagaaatgaattccagagtgtgacccaggagctctgtgtgtgggctgtgccactagctccctgggtgaccttgagcaagtctctttctctgtctggcctctgttttctctgctgaaaagtgcatggctggtagtagatggtccatagttccttcctactgcaaacacctgtacaccttggaggggaagtgatgataatcagaagtatccgaaaaacgcaggggagaagcttaggctcgctggaccaggaacatgaccctaatcccaaaccagggtagggtgaagccccttcctggacctgatgacaagaaagtggggggcagtggccctcacaggacagccaggaacacagcccgcttccaccccatgcttgttttactgcttcccactactttcccaataaccatttactgagcccctactgtgcgccatcctcatttttgtctctgctcaggagttatctggaaccttcatgggagctaccagagggcagaacctgtgtctgcaccgtcttgtgttcccacgctcaggccaaggcccagcacagaaaatacctgctttactaaacttcaggctgagagtcggctctgtggggaatggaagaggttgctaggcaggcctgtagacttgccatggtgacacgggagccaccttacgcttctggtctattctttccaggctctttgtatgagaaaaggagccaagagcccaccttgtgtctaggtttggaccagagcctgcaggggaacaaaggtccttgggactagtagatcagaagcagggggggctggctggtggggtcagggccctgaggtccagccacctccacctcaggaagaatatttgccctagaatgccagctaggagctttctgcccgggctcggcttacatccatcagtgctgcgttgatgtaattgctggattctccgtccactgagataaggaagggcaggcagcggtccagaggcagcacgtccatacttcgattcttatcatggttccggggcaggagcccaatgctgcagtcctcgggccgcacacggggtgtcacaatgttgagggtctgtggggcacaaaggtgaatagataggccctgctcatttggctgcccctgagcaaaagagacagtaatgttccaactcagcctaactcgcctatttccaccctctaagcgcagccccactctccctttcccgggacccatttctcttccacggtgatgttctgtcctctcctgctccctgctatagggtgtgtgagctgtgtgacaccttcaaaacgccaaggctgcagaagcagcgcatccacacacaggctcagacacagcctcatagtacctgccaaccagatgaactaagtcgttcagctcagccagtgctgctttaaagggtgggccagccaggagggcatacagaggggtgggggtagggaatccctactgagggctaaacatcacttgcgttgtcatggaatgggggaaatgatttaccagccctcttctcagagagaaagctgtctgagtatggaaggatgcctagatgacctgctcaggatagatgagagacctccgaggggcaaaccctaacaggtctgggaaattgctgtgtttggactttgccgagtacatcttgcaagtttgaggccagagctgaactgctctagccaatggactagatgttacgtgcaatgaccagtgttctgtaccctccatccttccctcattcagctctctgtctctacttcagatcaataatggctatttgttttagggattgctaaggtattggcctgcctgggatatctgcccgtggaacaatgggcctggcatttgcccactgacttgaagcaagacctggagcttccttgctttctcatacctggttctcagctcctgttgcccaggtgtaattctgacactggtcttgggataaagggctggactctggctttatcttacttagtgattcatgtccaggctccctagaccaatcaatgttgccacagctctgaccgcatgggcttccaggtgtggatctggtatacctgagctatgttctaggacagtacttctcaaagtttaacatgcatacaaatcactcagagatcttgttaacttgcaggctctcattcactatgtctgggccaggtccgagattctgcatttataacaagttcccaggtgaagccaatgctgctggtctccagactgcaggttttaaaattttatttattttattttttatgtttttgagatggagtctcactctgttgcccaggctggagtgcagtggcacaatctcggctcactgcaacctccgcctcccaggttcaagcaagtctcctgcctcagcctcctgagtagctgggattacaggtgcatgccaccatgcctggctcacttgttttgtatttttagtagagacagggtttcaccatgttggtcaggctgcagaccacacttttagcagtaagagtctactgaaaaattactgagaggacctgagtccctccagggatgaaggagcatgaaattcacacctgtttgtataaatttgtctccattcacaacttggactagaactgaataagacctcagttaaaaaacatattcacagttaaagacaagtaccagcaatccctgagtgagtgtgtagttgctcatggctgtgcattttgtgttctggaatagattctgcagcttcctagagaagcagacactgaaagtgcatagatcagttgtcccaaagaaaaccccacaaatgtgcacatagccactgaagttggttgggttactgttacggactaaatgttttcatccctcccaaaatccatgtcgtaatcttagcccccaatgtgatggtattaggaggttgggactttggaagacgtttcgatcatgagcatagaaccctcatgaacgggattagtgctcttataagaagaaacatgtagggccaggtgtggtggctcctgcctgtaatcccagcaatttgggagaccaaggtgggaggattccttgagcccaggagttgaagaccatcctgggcaacatagtgagatcctatctctataaaaagtaaaaaaaagaagaaatgtgagagcttgctgcttctactttccaccacgtgaatatgcaacgagaagacggctatctgcaagtcaggaagtgagccctccccagacactggatttactggaagcttgatgctgggcttctcagcctccagaaatgtaatgaataagtgtctgtcatttaaaccacccaatctatggaaatttgttataacaacccaaactgactaagatggtcaccgagcctgggatttgctcatacctgaaattcatctttgatttggctggagtttgtctgggggtccagcctgctgatattgtagtagagagaacggaactcacacacagggatggcagtgttgccacagaggcacgcttccaggatggcatcgtgcacaaacacatattgctcctgcaaagtcagaagagagggaatggggtgccaggtaagaacagtggcctgggaattagctgtccacatttagtgttgtggctatgaagaatagacatgatttatcaatatattacaggatccttactttttatactgtaacccaaagggccaaatttccatgtttcctaatgatcacctgagctatggtgggtcttgtttctgatagaagatgtaatagcatagtcatgataaaatgagaaacttctagacatgctgtcagcaggcgctcttggtgtccagcccatgtcccctcagctttcacctttacctgaggaaggctgcttgctgcaaacacctgtgattgtctgctgaaggcagaggggatacttgggctgtgtggaaaggaaccctcaagcaatgacagatggagagttgaggatagaaatctaagaaatctctccctttaggtggaatcacttggacacgcatgtgtctcagagttcgccagcagaattgggttccagttgtctacagtgtttaacaacttgttaaagtagcctttgtttgtttccttccctgctctgcctcactttcccattcaccagccactgtgtcttgggattaccttccaagcaaattatttgccggcaaatctttgtctcacgatctgctcccaaaacgtgtcatatcttctcctatctcaattctttgtacctgctgtactctcctcctgaaactccactccctcttttccatacctttaatgtttcattctttctggaaagccatctgttaatccaccaggcagaagttggtgttacttctaggccccagataaatgtttgttgagtgactttttctgcagaacttggtcagtttctctataaagagtacttttccagatgctatgtgatgcatctgcatttgaatatgtctccccatatgtctgactgcaaccagcaagcctggcttctgcatgcatggacctaggaatagataaagcagccctcttggctttagtgctagaagcctgaagactggcctgtgtgagttagctcagagcctatgtgtgtaaaccaatcaatggtggtattcactgcagattcagagaggctggctgtaccaaaaccatgggtcacttccctttgcaggattgatgatgtgcatagttccctatctgtcccagctctggtcgcccaggcacccagagccttcactagaacagaagatgggctcgttacaggaatgataagccaaggtacagagtgggataggcagaaaaggctgcttagtgagagtgtggttctggcgaaaaagcagaggcctttgggggtcacatggaccgaagttctaccacagtctggtatgtgaggtcttagggacacaatttcttagtttcttcttcattgataaattggagataatactaggagctacaccatagctggtttggaggagtagaaacaataccgtgactagaaagaatgtatgctgcctggctcacagtaggtacacaacaataaagattaattcctttcaatactcttaggtttgggctctccaactgcacagagagttgcctaaaggtctgcttctcccttgagggcagaggctgtgtgttacatctcttgaaatgcccagcacccagcttaagtactcaattactttgttgattaaaccattccctgcagtgactgaaccatcgcttggcacgtagtggtcactgaataaatgccagtccttctctttccttctctatcacttcacccaaggcaagaatactattccaataatccccgaaatttgtcattctgtccctgcttggatggcctcagagatggagaactcaccaccattcttcattggtggaactgcctgcactgtagacctccagggttggctggggcaccctagcttctacagtagtctcaccatagtaagccacgtgtctactccctcctgcttctctcacacccaggtcctttccataggatgcccctacctatgtgtctctccgttctatcatcatgtttctccttggtcagggctacaggtggccaactgtcttggccccctaggactcacctctgtctgtaccaggttgaccctttgggcccggagctcacgcacgcagttgaagatgtccaccaccccttcattctcggccatgtcaagcatggtgtcaatggcaatgaagcagccagtccgcccagccccagcactggaagagaggtatggtctgtgttaaggatcttcatggggggaacctgccctggggaggcccctagcattcagccctatccccaagggtcctgctgggaggctctagattatgtgttcccacatttcctttcttaatatgtatagtttgtaatgcatgtgcaaaccacacatatacatgccattgccttgtctgatggataaaataatacatccatatagcataaaacacctagcatggttcctggcatgctggagctgcctcatagatatgtctttcctattttctacccttcttttctcttcttttttcttcttcagcaaatgggttgacggatggaagcaaagaaggagaggagagagaacagaggggagatgaatgacaggacagaaacgagagtcctctgagctgtccccaagacagagagtggttggtggagcaccacgttcaaaggccggcatctggctccacctgcagctgttttcgcaggatcgtgaagcaagagtgtcatgaaactggagcagctgaccgtccggagacccttgtcagggatcaagtttcttgatacatacttacttgatttctggtcactagtggcttctttaggagaatctcagaccaagtataaaatggtaggggaactcaacgagactctatgggccttggccagccctttctagatcagtgctgggctctgaaacatcagtgctgaccaagaggcacgtaagacatgtgccttacacatgtgcagttttggatgggaaggccgggcagcctgtcaaggaggcccccttccgctgcgttttcacatcttgcctttctcatggaaacaagtgtctttgtctaacaatgtagatgtcaaaagacacacaaagaggaagagagatggaacaagacaaaaaagcaatattggctcatggtaaatccaaggggcacaggccagtgcggaccactacctacaacaatttggaaagtacacccattggaagcagagtcttcattcatgagaaactttcatggtttgaatgaagtctgacttaagtttgcttcagaacctactccccaaaatccagatgcggggactcaagagacttggcctctgtgtctgggagggagtatagggggggtcactcgtgtttttttcttcaatgttcatattcaccatgctttagtataaagaatcagcccaatttggttccaaattttggaacaactatcaatcaatcagcggtgaccaagttgcctagtgtccgtttgtttgttagcttcagatttctgatgcttttaacatacctccctgcagggtccttgtgaggacaaagctgtgtttatttcatttcagcatcacatagtaattgaacacaggatatttgaaaagaccccctaggattaaatcctggctctattacttattagctgcatgacctcgggcaaatgacttaacctctctgggtttcaatactcatctataaaatgatgttgataataattaaaatactcactcatctataaaatgatgttgataataattaatagatccacctcacagcattaatagcacaatatgtataaattggatgaaattacaattaaaatgcataatgcatacaaattgctttgtgcctggatacatagccattttttattgagaaattattactattatattcaacaaatatttattgaaaatctaagatgcagtagatgctggtattaggagtgggaatatgaaaacaaacaaacattgttcctgtcctgaaggattaataaataatctggggagggggagaaagaaaacattaagaggaggcagagaataatgatatattagagtgcttactatatgtcaggcattctctcttaggcacttagccaacccatttggtaataattttcagaatggccccaggagtgggtaccactctgctcagatgcattaagatgacctgctaaggagacacataccggcgtagagccatcatgcgccgaagtcctgatgataaacaaacatttgccattgtctttctttctttctccctaacccttgatctgggtgctctttgggatatagagatggggggcattaatgatccattgccctttgattgctatgagatataaagcaaagcagaaaatacatgcaaaacatttagagagtccaggattacctcctcatcctcacttgccttatctgtgaaatggggttgtgtagctactattgctgggaagataaataaatggatgctgtatgaggacggggctggctctgagacatccacagcttatggagtcttccatggtctcttgactgacacaaactgccagggcagggatgtgataactcaagcatccagggtctgaaaagatgggctgccccaaggtcatattggaagagagaggcgttgggaaggagggggatgccagctggccagccttcaggtcaggaaggccatcctcctccaattctggacacccttgacaggatacttcatctccatttgggaggattcaaagacatgccactcattctcaatgtgactttctaggtcagagctgaaaatatctcttcttcataataaggtaaaacctggtgctgtccatttctctctatgagggaccctgcaggctggcaagtgatcttgaaaataatatagaaatgaaaagaagcatgcttccaccaaggcgccctgctgccatgtcaaggagctgagggcaagtgtctggagaaaagcaggtgaaatatccccactctgtgtttacctcctcagcacttgagtttttgtatctgtaaaatgggaatgttaataatgcccacctctccagactggacgagaagtaaataatgtgggtaaaatgcacgtgacagacccagcagatgctgccagtgttcagcctgcctccctggtgactgacttcttcactgttttcaggcaacaacagtaacaatggccactactgctattccttttgttagctgaccttgtgaccaagtatcatcagaaagcactgggcatgggggggacacaggaagaggagtctctaagagtaaagccactagaaaagataacatgtccctcccaagaaagccgagctgcagaggcacactagggtaggtggaggactttttctttttttttttttttgagacagagtctcgctctgtcacccaggctggagtgcagtggcgcgatcttggctcactgcaacctcccgctcctgggttcaagcgattcctctgcctcagcctcccaggtagctgggattacagatgtatgccaccatgaccagctaagtttttgtatctttctttagtagagacgaggtttcaccacgttggccaggctggtctcgaactcctgacctcgtgatctgcccgcctcggcctcccaaggtgaaggacctttgacttacctgcagtggaccactatgggcccagcttccggggggttgaggaacttgacctggcggacgaagcccagaaggccagtggcatagcagggaacgccgtggtcaggccagctggtgaagtggaagaggcggagctcccggatctcatggtagcctttctgaggaaagaacgggcctctgttcttccagctgctgccctcgcatacccagcccagcaacacgtggagccatagctgctgcactgaggaacctcccgcagggacagggccctcacagtgtttgttaataggtgttactggatagagcgattctgtaatcagttacatttgggaaatatgggattgttaaaacgaaaccgatggctttattgcaggatttctcagagtcttgagtgtgctcatacacactctgaatgcccaagagggccacagagcaccctaggagaccttcttttgtttgcctaggggatcgtctttgacaaatgtttcataggaggtgtattgagtacggatttaaagaaatgttggccttaaggaccaagtcagtccaaattgtttccagtggaatctgaggcgttcagtgattgaggtctgatattctgtagtgttccagccttggctgtgatagtctgtgtggctttcaaagtttatataacttagtactgacttctttattaagtagattcttacttagaatgattacataagatgcgaaacaaacaaaggcagagcttctctgatctgatggagacagagtggggcctagagctctgagcggttcccctcccctttcacacccctccacccctcacagagacacactccgggcccagtagtggttttctgaccattccatggccaggtcacacttctaagccttcgcttagacagttcctgttccctactatttttctacttagcaatctcctgcagatacccagagaacactgaataggaagagtctgtttgattattcattcattccttcattgaaaaatcatttaccaagtgtgacctgtgcccagccttcccagccttgtgctaggtactaggaaggtgagaataaaagccacagctcctatccctggaacagctcatggccttgtcggggaggcagatgcccaagtgggtaattctattgaagtggataaaggagtgcctgctaacctgatctgaggagaagagaaatcccagaaggctttctggaggaggtgatgcttgacctccatcttgaaacagactaatagtgaaaataataactaacaaacattaactaagcatttactgtgtgccagtcactcttctgaacacttcaacatgctaacttacttaatcctgatataaatccctatatttttatctccatttgatggatcaggaaactgaggctaaacaaggttaagtgacacacccaaggtcacagtacaactcacaagttgtaaagggaccatgtgaaccctggctgtctgtctccacagtctgcactcttaatcattctaatatagtgatgtgtgagtattacccagttgacgggagaagaggaaggaatccaaggcagggggacagcatgggcacaggcctggggacagggcttagcatggtgtgtgcagagaatcactagcaacccagggcaatgctagaggcaagtggaagtcaggccatgggagaccacaggcctgggggtgcaggagaatagatgagagctggatcccagaaggccttgaatctacattaaggcctttggactttatctcaaaggcactgggaagctacagggagattacacagacggttccacacaagaggaagtgcatcattagacttgcattttaggaggctgcatcctgctacatgaaggatggattcaggtgggtggatcgggggttgcagagagggcactattggtgcccactcagatccccatcactgggccagtggactcattgccacctgctctgagtcgtggctgcacacagctcacagttaccctcttctgaagagaactgttctcagctgaacaggaacccccctcccctggggtgtggctgggtggggcagcatccttcagtgactgactgatagtagagggagagtgaccaactggcttgccacttgctcagtctgcccaggactgacgggttgcccggtacgtgggactttcagtgctaaaaccagtaatgttctgggaaaaacagaaattttttttacccttatggggggcacctgaggcccctttgcctcaaggttggaccaagtgtgcagtaccattcatgttccagggctcccatggggttaggtggaagcaagtctctgctgaggccacttcctcactcagctcctttccccaccccatcctggctctctcactgccttccccctgcaaactctccctaaacacatgagccagggcacccaaacgactgctgcttctggctctgcttctgggaaacccaaactaacataggggcaggactagaggcagacagtcctgttaggagggagaaatcagatgcccagatgaaggcagtgatgaatgagctgaagtgagagaggagaaagcttcaagaatacttggacttttttcacgccatcctccaaatcaattcagtcccaagaagccttccttcgagctcttcccacctgtgctgtgatgatttatcaaggatcctctctccccgatgcgtctgtgctgtcttcaagggcagacagcactccctgtttattatttccaggttcccagctcaggaaccgattttgagctaaaatcgcaggtaatgtttgctgagtgcctgcctgcatgctgtggagaggctggctaagcccagttaatcctcagaggcccttggggtcttttaagggcatctccctgtgagtaatatcttccctcgtggttgtttaaaagacaaagaaaatgtaacacgagaaaggaccttaatgcctcaacatggtttgctagctgcaattcctcaaggcctccctgcccgtgtcgccagtcactcatcccatcctcgggcattcaacacagatgtggcagatgagactggtacccctgggtcctcttccttgggcctgtgcttccaggcctgagctgcagggactgttggttgctactgcctttcaattgtccccttctctggagacacgccctcagctgacaggggctggcccaccctggaggttacccctcagtggatggtccacgatcagcagactgactgacgtgggagcacagaagtctggcttccacgccttaagggggacaactcactctgtggcatagtttatccttggaggttccctgtggatcagctctaggctagacttcactggagcctctgtccttggttggtgtctttccttccctctcctgcttcccactctctcttaggaatttctcctgggagagctcccctgatatacctcatgtttctgaatccttgcctcaggctctgcttctaaaaaacctgacctaaggcaacattgaagtaccgatggtttccttcctcttagtggagggagttcacaggcttcctgactttttcacccgagactgcagattcagatgaaaaagaccctgagactttaggagcctgggggttggagggggagcttccggggcaaacagtatgtcctaggccactctgtatgctggaacagtactgtgtgcatgccgggctctagtctgcagagcagcctgctttggcccttgcaaggacttgtcaaagcctcaagggcacagctctcaaagcatgtaagtccccagtgcttttgcatccttaggcctgtggccacattgtctattaaagtgattggttttagagaaatggaacctatggtgtaatggaaagagaaatgtgttacaggagccaaggtgtgaatcctggttgtaccaaccttgcagctgggcaactttggatgactgatttaaactctctgtgtctcagtttcttcatatgtaaaatggggataataatagtgcttaccttatagggttattgggaggattaactgagttactctacgcaaagcatttagaaaagtacctggtccagtaagtgctcagtaagtgttagctatcattatgatataatagtaatgatagaatagcaattattatgtaacatgttataaatatatttatttgcaatcacatccttgctcaccaagcttgtgcagccctggcctccttttaatgtccagaccagcatttctcaacctcgacactactgatgccttgggctggataatcctttgttgtcggaggctgtcctgtgcattgtggaatgtttataagcatctctggcctctccacccactaggtgccagtaccatcctaacccttctcccccaagttgtgtcaaccaaaaatgttgccagacatttacaaatattccttgggggatcaaaatgcccccggttgagaccacatgccttgaacaggttgagatcactttttcccctccagactgcatgttttttccttctgcctgggatagctcttctttcctttctacccttcactggttcctcctccctcattctctgcccaaatgcctcctctgctaagaggccctctcctaccaccccatcctactgtggatttctatctccatcctttgcatattcctgtgtggcttttatcacaatgtgttgttatttcattgatttgcttattgaattcagtttgccccacctactagatgtgggatccctggtagcaggacccatgtctgccctgattgctgatctgttgctggtgccaagtatggggctggacgtagagcagaccctcagttaccacatgttctggatgaacaaacaagctggctctcatggtggaccggctgcccacagcctccaagaagcttaccttctggactgtgaaggtgcgtatgacgtattctgccaggggctctgtttcaatcagggtgactttaatgtctccgtagacctccgtgtcatctggccagtatcgcacacatttcacctgtggccaagtgagagacagagacagagacagaacagagacaaggatgcataagcacatggctgagtgtgagcagctgtctcatctggtcgtcccatccaaataaacccaagggtgactttggtggcatttcagtccacagggttcacagctggccagggatcagcaagctgcacagggccaagctcactcccagaggcactggagccattagaaataattgtagtaccttcttttgcaaagctccttgtaactttccaatgcattatcacactatgtcatcaaatagaacaaggtgagataggtgggtgttattgtccccactttacagatgaaaataatactgaagttcagaggtttggtgacttgtccaaggccatgtggccagtttggggactgactgagtcccctttctgctctgtcagggtggagcagctgagtatcatcagctgagcaaagatgagaataaaaggtgggaaataggaggtggaagcagaagtggttgggagggggacatcattaagaggtggcagttgggggtctggaaggagaaaggctcttggttgggaaaaggatggtagctgctggactccaagggaagatgcgcagttcctctctgaccctggacgcgagcaagccattccccagtcgactgtttaagtcgcactcatggatgaaaaagagatcatggttttccccttaaaagaacaaaagcatgattaccattccgggggacgccgcacggcctagagtggcatttcccacagtgtgttccgctgggtgctaataggtgttaggtaaaaaacaagaaacaaaaaacaaacaaaaaaaggttttgtggtcaaatgagtttgggaaatgctgtattacacagttaaataggcagctttgctacaggactattcagcttctttctcatgctagtgctaatgtgttttgtgttttgcgactctccaaaaggggcacagaggacgcagcatttcccaaacgtatttaaccgtggaaccctcttctcactaatcatcctgcagactagcatcccatggaacccacttagggaaacactggtatagtgcaacagagcatgggggcaaatggattcattgtttggtcctaacactcagtatctgggtggcccaagaaagtgctgaaacctctctgagcctcagcttcctatcaataatgatagctaacatttactgactgtgtactctgtctaccacggctcacaaagtgttctgcgaatactttacatgtattaattctaatgacttatcaacacaactttatgaagtagatattatcatccccattttgcagacgaggaagcataggaaagctaagaaaattgcccaaggtcaactgttggtaagggatggggccaggatgcaaacccagggcacttgaataataactaggaacatgggctcctatgatggttgtaggtttcggtaatgcacaataagcacctggcacagtgtttggcactagcaggagcttatctaagagactgctttcctccccaaatccaatttagatttatggtctatccatcaagggaatctgtttccaatgggggatatattgtagaacaggctggaatttgcctctgaatccctgaatcctgggctggcctttatgtccacagtagctgcaccctgggcctgggtccctggggaacagtctgagtggagtgaccacaagcactggaatcagagtccagcgtcagattttgtgcctaggttttggctgagtgacgtcagggtaggtactctacccctttaggtctgtttcctcatctgtaaaattgagtgatggactagataagggtggactcatgggtaaagtctcacctggtcctaaattcccattaggccctgagatgtccatacccctttattggattacgaaagcccagattgtctccttcccatcgtcgcagaggccagaattcatctttatgaattatctgtttcttacccaaacaaaaacttacctgcccacattttagttagttcatatgatgtgtagagagcccttttaattctcgtgtttgtacaccttgcctttaaactcagcagcccacccacatgccagagttaactaagtaggcaaaagcaagctgggaatagcagtcccatttctaagccccaggagtagttgaggaccacttcagagagagttgagatggagcagagcaggagaccaagatctgagccctgaagaacatcaagatttagaggtcaggggaagaagagcgggtagcaaagggttggatgctgctgagattgagtaagatgagaagagagaagtggagactggatttgtcgacatgaagggtgcgagtgatattgacaatatcactattggtgggatggagggaggagctacgctgcggtgggtagaagagaacatgagtgaagaaacagagccaccctgtgagtctttaaagtttggcagaaaagagggaacaagaaaatactttttatttaccttttcctttctttttaagatggaaggtactgggcatgtttgtatgctaaggggaacaatttggcaatgagaaagagacttattttgcaagtgagaaagggaaaaatgaaaaaaattattgagtagaatctgtgatccaggcactatgcttgcctttggaagggcagagacatggcttctgttgtgttaggctgagccataggaaacagttgacattcgaccatttgggtcaacaaaaacagccatttcttatagtcaaatctgacagcagaggagaagaacaagaggacagttgtagatacaagtaggattgtggtgtgacaatgagggagtgaacgactgatggttttaatttcctcaaaatatatgagatgacatcatcaacggagagtgagggtgtaaaaagggatgaaggggatttgaagggaaaggacattgcttgaatgtggaataggagtgatgacacctcccttgtaggttgccgtgagggtgaaatactgactaggaggcacttagcacgatgcatggaacaaagagatgttcgagagtgcatctccagcatcctctgcccaggcgagtgcaggagaggcttaccctgcccacttccaccaggtttgtgaccatgacgatgctggcggagttctcctgccagatcattctccaaaagtcctttacagtctcctgcatcggacctgccaacagagaagacagtgaggttagagaatgcaagtgcaaagcagcagctgagaaggtttgtccccccggttggtcaagtctccacactggtgagcaggagtgaggccaggtgatccttgttaagacaccaagtatctgagacacgggcctgagacatgtgagcctgatggggacagattagggtatggatggggaaaggctcattccaagctctcacaatctgcagcatctactggaaatgttggcagcctctcctctcccttctgtcctcctcctgctcagaccctttctaccaactccacctatcaccttatctggactgtattatggcttaagggagttttcgaaaattggtctccagaacctccatgagagacaggaaggcaactggggtggggggtggagagagctgcagggtgccagacgctgagaacaaaaacaggagatgcctgattttgtgcttgacaaatgctggaggcattcctctagggcctcaacagaaaggaaggaaaaaaaaaaaaaaaaaaaaaaaaaaaagaccaggagcagaaaataggctctgacagtccaaagcaatttccttggaaattactctttcaatgtcctgggccttcatcatttttaaaattacaaaagtaatacatgtgtttgatataaaagtttgaataccatttttctatatttatatgtatatgtgtgtatttactgtaataagcatcagacctattatatgcattttctgatgcccttaaaaattcttaccaagcgtaacagttttaatagctgcgaagttttctataatatggcggtaacacactttatgtaaccaacgtaccaattgttgggcatttaagatttttcgcttttttattcctattatagataacaccgtgaataatgttcttatatgcgtcattgtctatatatataattatctgcaggatttttttccagaagggtttgaaaggtacgatcatttttaagccttctgaaaacgcactgccaagttactttctagggcagccagctgcatatctgttatgggcatgcacctatcgtggagataaggcaccatcagctccggccctggcaggtgttgatggcacctgcttgggcctctccctcctgaccaagtgaagctccttgctctgtcactcatgggcctttttcctatagtgaaacttgccaccattttccttcccaaataaacaaatgaacaatctcaaggacctctggagagtcttcagcctacccctccgtggcttctttgctggtggaaactcattcctctcctccagggctgtttagtgaaaaaggagggttggagtaacagatataggaggagaggacaagccttgcagttaagagagccctttcccctgggacccctgaagcctctctgaggcactaggtggagggagggcacttaccttgagtcgcaatgtagtgccgaggtcgatggtatccctggataacaggagaaaagcactgtgaagagtctgttgtcaaagcttgcaaacagcacaatattaataaacatcctctccaagtcttgattttctcatgggcaaaatgagaacagcatcagttattcccagagaagtggcaaaggttaaatgagatattgcacataaagtgtgtagtaagtcactaaatgctagctatttttatagttacttgtgaggtgcctacataggcttgccttggagccagtggcactgggagcaaagattggatgggcattgcttatccttatgcacccaaaaacaggtagagaaggagtttccaggtttatggggagcatcaaccaccaaaaagtctttcttgagccatgattatatgaagaacactgtacaagaccctatgggacacccagagaagaaaaaggaagaaaacaattcaattgttgacttcttccattagtaacaattagaaaaagaaaattgagaagcatcccacattgcttctctatgccaacattcctgggcttggaattgaagtcccaggtacggagaagaccttatggaaggctgacctgggagacccataaagatacctgcaaatacaaagaccagtttctaatttctctgtacatttcagagcactacagtaggccctgctgtactctggttggggagtaccctgctgccccataaccttcatcattggacaagaggttgaaggtgacccctcttttgcctggacatggcatacatggagtgtcctctttccagttacagtcatattgagtagaagtttaagttttggagacagacctgcatttagtgcagaacactgaatgcaattagtatttgttaaataaatacatgagtgaataaatgaatagatgaataaaatttttaaagaacacagatgccaattttagagcctatcaattgggagattgttgacagtcctgaaatccacttagcttttatggttaaccatgtccagagaaaataagtcctaaagtttgatgaacatctgtctttgtcttagatgttgctgaccagtctttttgccctgttgaggtagatgaactgcctcgaggccactttcttcaggaaatagaactgccatctgtatggtttatggtgccacagatgtggcatctctaaagttctagacccactttctgatacaaagacaagtttctgcgtcccttgtacatttctccacctttgtgtttcacttgctcgataatgattttgcaggcaccttccaattgctgggcctgctctagagttggaggttggcaccaatccaggggcaatgtcatgaccagaactgttggattaaccgcagagcaatcaacagccctactaaaactctgtgcttgaggactcctatgtacttagtgaggttgtcagtttcttaaggacaaacactccctactaagcttaaaattttttttgtcacagagctcagcacaatgtgagactcagagcaaatacccaataaacaagctgttgacaaaccaactaggcaggcaacacagcatggtggttatgcgtaccatggactccggaactcagctgcctgggtttgaacgctggctctgtcccttctagggtgtgtggtctagggcaagctacttagtctcattgtgcctcagttttaaaattcacaataacaaagatatgaaatcaacctatgtgtccatctcaatggatgactgaataaagaaattttttatatatatatatatatatagtattccatatatatatggatatatatgaagagatatatatatatagatgtagtattccatggtgtgtgtatatacatatatatgtgtaccatggaatactactaagccataaaaaataatgaaatcatgacttttgcagcaacatggatacatggatgggcctggaggccattatcttaagcaaaaaactcccagaaacagaaagtcaaataccgcatgttttcacttacagtgggagctaaataatgtgtacatatggatgtaaagtgtggaatcgtagacattggtgactcagaaggttggcagggtaggagggtggtgagagggatgagaaataatttaataggtgcaatgtatactattcaggtgatggttacactaaaagcctatacttcaccactgtgcaatacatacagtaacaaaactgcacttgtgctctctaaatctataaaattaaaaaattaatggggataatggtatttacctcatagtgttgttgaccagattaaatgagttgatatataacagttactatgtgccaggcactattctaagatttaacatatatgtctttgctattgttattttattgtttatttggcaaatatttatttactgagtgcctatcaagactaaaagtgtatgcaggcctctcaggggacactgggatgatgagaccttctttgtgttaatgtaataactgagcccttccctgtgacacaaggggtaggaagacctatcccttcctccaagtcaagtggacagggctgctcaggctaaaagaaagaattaaacccaagggttgtcttgagtagctttgggaatagaaaatagtcccctagatcctggaaagatgcagtttctcaagtctgccctcttctgccattcccatcactcattcccacagccctcatcctccctggctgaggccacagcaccaaccactagctggcttccctgcctgcagtttcactctgtagccttgctgcttcctaaccccatgagcttcctcttgcacactgagtgtgttatttccctgcttataagcctgcagtagctccctattgtctgcatggtaatgccaaatgccttaccttcggactagtcatctgtctccattttcatctccagcctcacctccagttgtccctctttgtccactcctacaaccccatgcaccctgtgcttcagcctcaccaagctgctcttgaaatatgctctcctctgggatacagagctgactcattcctcctgagtggcccagtagggctttgtatatgctcagtgaatgcaattccatgtgctgcagtaaatttttttgtacctttctcctcctgggacatgggacatgccacccagagctgggtgcagttttcagcagtctggttggtgaaatacatgtatgaatgtttttgagctgaagttggagcatcctcttaatgctcaggctggaagaaaaagagaccctggaggaagctgtgatttggaagattctaatgtgcttgaaattcagtgagataacattttgagcaagagattcacattttagttgtggagttagatggcttggattctctattttgtgaattcatttgtttgcacagttattcactgtcaatcaacaggtattaagcacctactactatgtacaaggcactggaaatacaaaagtggacccgatgaatgtggactttgcttttgagcaacttatagacatcaacagactggggtaaaggctactaatgggaagatgtggggactctgtggagtacccatgggaattgaacagccaaggagggtcccctcagaggaggtggtggttgattggctccttaaacctagtttgggcatcttgacacctcttgtcatttctatttcatcctttcagtgatgttcccagtttctctgccattctttcatcatccactggctcttgctcttcttcagagatagggatcacatgtccatccagaggccttagcactggccattccccgtgcctgctatgtctgcccccaggtacctgagtggcttgctctctcgctccatccaagcttctgctcagttgtcaatcacgtctgtggagagttcatctctgaccaccccatcagcttctttccactttctctggcttacttttcgttagataacctatcaccaaatagcacactattctttcttcatttacatgctcccccagttgaatgggagctccatgaagccagggctggcttgctcatggccatgtccccagcacctacaagtcagcctgggccattggccttgaaaaattcatattgactgaatgtacgcatgctgtgtgcctgttcccacgctgcatctgagtaaagagaccctccttggcttccaaaaacccacgcagtccccaaagagaaaacattctaaccacgagactcctcagcaaaggagataaaaggaaacgtactgctcaattggggctcctctggggattcgccaagagcgagtacagaaaacttcctaaccttaaaagaactttgagttcatttaagtcccacctacacagcacgcagattgactgcaaaccagcactgggcctgcctccatctgtctgtgagcaatgggaaagaggtttgcatccaaaacgcatttatctcactctgcactcatgcatctgttacttactggggacccagatacgatatttatttccaggctggtaattcataacagatttaagtggccaatacattttcgggtgtgcaaacaaacctgccagcgggatggttcagacagtaacagaccacggcctccggaggcagagacagggctggccccattcagctcattgtcccaatggagttattttaatgaatcgtcaagatccaattgtagagaaatgattctagcatgggcagttagctctttagagagccaggaaggattgtggctgcgttggagaccagggtgatggagtgaggacctagttagctgtctggagtactgttttgccaggaatccctatagagaccccaggaattttatctttgctggagtatgtagttggttcacaattaatggagttcctctactcttcaccctatagtggtaactgtgcaaggagttgcttgtggttggctttcttccctttgtccctccatttcccctttttccttccatggtctgctctgtatggatcgcgccatgggctcctattctttctgcttcaaattgggtttagtcaatggggaacaaaagcaggaactcagaggccaggaggaggttggggcatatgttcttctaggttcctccctgccaggtctccatgccttgcttgaccttgtcactcaatcaagggcttcagttcttgaagggcagccctctctcatagctactctcttcccttatctgggtctagggctggtaaggactccctactattgttagcctagtgatactgcaccctaccctactggtttctcttaatcctgttcacatccttattaaactttccctgggtacccactttggggaagcctatgtttccttttgggatcatgacagatactttacatcagtaattgcacacttgtggggtggcatcattatctcattttatagatatcagaatgattaagtaatttacccaagatcataaagctagtaatcaaaaaggcctggattcaacacaggtcttcaacacagaccagattcatgactttattggccctggattctaaccactgagattgagcctggagttcaatatcccataataagacagcatgaacagaggccatttgccctgtctgcctaacctattacagacagaagaagaaggtcgtggtgtgtcctaagtgggcagagaactgaagttcagttgtgtgaccttggacagtgctcttaacctacagctctggtttcctgtctttaaaggcttgaaacatgccttgcaatgataaaacaggaaatgaatcagaggcataattagcagttgtagagattaacttgcatttaaagcaatttcgtttgttgcctataaaataccaaagtgtatcttggccctgactgtagtcagatgctcattcaactttggagtgagtgcctatctaggaaaatgacttttgttgggggattctagtcaaatgatgaatgccagatacagaaactcaggcatgccagaccctgtgtggcctgtggtccttagggtcatatccatgcagccatagacaaggtcgaggagaaatggaaggaatcaattcaacctgcatcaatatatgctgactcggtccttgctgtgtgttggctacaaggcggtgtctgggagtggggggggggaggggaaggagaaagagtgctaaactgggagccattcaggtctggttcccatcctggttctgccactgaccagctgcatggcctgagacgtatttgtgatttctctaaaccttagccctccccatctggagaatgggaatgagaacacctaccttgaagggttgttaagaagttttgataagctgacttacttgagccacccatcataggaccccaagagtgactcattaagagccagttggtgttgtcattgctcactgtgattattaaagacagcagggtatggtgggagaggtactcttgactcaaatttctgctccctcctcccctacctcctagcagtataatcctggacaagttatataatcttaagagactcacttactcatctggaaatgggtagtagtggtacttaccttgtgaagttgtgatactagttaaggtgatgttggtacatgaaaggtgatcagtaattcttaggttactataaacccttcttgcctggctggctctaagtcatctttcaaggcagaactgagacatcacctcctccagggagccttcactggctacttccctttcccaccaacttgaagctttgattttcctttatggtcccacagcccctgctctgtgaaggtctattttcttatctgactccctcaccagatttgagtcccttttaggtcagagacctggtcttaaaagtcagtatttcccatacacagtggagggtctgctctgtgtttgtgaactgaatactggatgtatgaaggaaaggctgctggcatgatggatgtatgctcagagtgccttgctctgggctggagaaaagctattcagaactggctgtctcctgtgaacttttctggaagggctatggtggcagagacggtgttcatcttcaactccactgaagttgcagcctcagttcttggccatgtagtaggccctttgttaattagggtgtagttagggaaacagaaaccagtctatgtgtttcagacgaggcaattcagtatggggagttggttacacaagtgatggaggagccaagatgccaaacagagaatagtggggcaacccagagatcagggacaggactaggctgcaaccaacccttagaactagtgggagaacaggagagggagaaataactagagtccagagtccagaaataaccagagccccagtgggctgactggcaggagactggactatggcaggcctgcttgaggaaagatggagccacagacagggtacagccactgctggagttgctgcccaaggaagggagtgagatggagaatacactgcccttccatcatcctccagtgtctgtctgtctgtctgtctgtctctctctctttctctctctctctcacacacacacacaccctgcaatgcaaggcagaacagggaaggacacaaaatagatctgagggcaagcagtcagatgatcaatacaaggctcaataagtatttgttgagttaataactcacctggcttagtctagattaagggggaattcacaaactgcaccaccacactttatagcctatctataaatacatttgagagtctaggggaccagtatgaatctctgtgccattcttcaagacccatggactgtgagctgaggtcctgagatgcatggcttgaatcagtcacattgggttgtccttctgacctcagcagtcatgctcttgcttagcaaattctctcacttccatgcatacccttcttggctcctgtttgagtttagtcccttcctcagtcgtctctggaatattgaagcagcctctttccttattggttgtagttgtcttaattccagaatttcttccctcggatctgtcttatctttggtagcagataaatcatgccaaagctcagttctaagctggtcacctccttgataaaaaatttttaatagcttcctcttgtctatgggataaagtcccacttcctaagtctgagcatttaatcttcactgatgtagtcccaacaatattttccattattcctgttacatattctctgctcccctcaaatggagctgctatgtatctcctggccagttgctccatcttggcttgtgctattctctctaactagaggcccctctcccctctctttgattttaaatcatatctgtgcttgaagctttggttcacatcatattttgcattcctgatgggagaagtgatatttttccctacttctgaatctctgcagcatgttatctgtacttttgacacttaacaatttctactttgccctggaattattgatgtgcacattatctccctgctaaggttttaaagggtagagaccatggtattattagcattatggttcccatagcatctagtatacattttacagtaggcactttaaaatttttgtggcataaatggccatgcgtttatgtgaatgaatgaatggatcaacagacatatacacaaatgaataaatggggtgaatgagtaagactaacagttgtcctgaggccccatagagcaggctactacagctagcctgaaagtggatgcagtggtagatggacagtcaacttgggttacactagttccacatatcaaggaggatccagactgctctggaagggccaccttctggaggagagtttggggtaaaccacagatcttgagcctgcaaaagccagccccagcccccagccccattaagacactcacgtcaatgtagttggcattgatgtagtcagagtgcgggtctccatccagcaccagcagcctcacccgggaatggtcgtctgcagagagagcagaaatcaaggggatggttgataagaggccttacgcagctaatgtcctcctttagaactactgtttattaatgactgcatatcaggcattgtgctactctcatttaactctcaacaccaccctcagttactgctcccatttatagatgaggaagtggaggctcagggaggtaagcacttctcatttttctaccttcccttctgatttcgtcattacctaactggattagtcacctgtttctttaagtcttagtgacttaatcattaaaatggggatggaaatacttgcttcataggacaatgtgagagagaccatataaaaatgcttaggacaggagagtgttgcatctggattaatatactccattttcatgttgtttaaaaacagcaagtttacctatcttccacacatgcacaaattgcttttcatttgccccttggagtattgttagagatagattgtcagccatatattgttatcaatactatcattaaagtgaggctgactaaatcattataaaagaggtcatcaataactaaaaattgtgttatagaggatgccttttcaaacactatctagacataaacaagatttgcaggctttatttggtagcatgcttacttcaactaacaccaaataaaaaccattaaaagaaaaccagtacagcagaagaatcaggataatcctttacagttaattaagtgagctctgacacgctaatagacacacacaagtggaacattggttcggtctggttgggaggagggaccttggtttgctatccaggtcactgtgcacgtatcattgtgcagtcactgcatcctagttcaccttcctctagggcaggaatgggtccctaagatgtgggctggagagctctggacatccccaagggttttctgggagtcacggaggtcagatcagcttatcttcttagaattatacagcattctgcagtttacaaggcacatttattgcaattaaccaaaacccccttgagaactgggacattatgccttattccctgttccatcccctgcacctttaaaaggtcctgacatacagcaggtactcagtagtacatggaaaaggtataattggatgccctcattgggttctcacagtgaccctgtggaagagaagtaggatgggttcttttagcccttgttacaaatgaggaaactgaggctccagaaagcctgactggccacatggccagtgaatggtagagcacagaggagtgaagttctcttaactctgagttcggtcgctcctgtttccaaagggggtgtaagcacaatgttagaaaccacttcagatatacccagcagagggaattaactactgagaagtggttgcctgggttacaaagagttgagcagccagatagaagaaagtggagaaactcagagataagcagcaacaaggagacactgcctgcccttgggctgaagggatggagggaggtggtggagttggcagtgctcaggagctggggccacctgctggaacctgaagccacagtgggattctagtaggagctggaggcaaggaggtgcttcccttgctgctaaggaaggcaattgtagttgtaataccctggcttctccctttctccttctctccaatctcccagtgcatgtcattggctaaacctaaatagctgacaggagagcctgaaaaacacaacctgcaggggtaagttacctgcaatgcacactagagtgggagaaggtaaggaatgggtcctattatggacaaacaggcctagggctggtataagatacaccccatatctatccattcatttaagaatcattcactgagtatctgccatgtggcaggcaggcactgtgctagacagcaagttatactaaatgcgacttttcttactcatcagggggaagtttcagcagaagcaactagagggagcaggtgggtggtctaagcaatccctttgggtgagtgggagagtggaatgtgacatgggggaggagtttgaagttaacctttattggattcatggtaggtaagagaaactttacatgcattatctccttcaaccatttatgcctcaaaatagccatataggttattataaggataccagaatgatatggtattatgagtcttcccattttacagatgaagacactgaggctcagaaagattaagcaagcttccgaagttacgcatcatgtgtgtggcagagataggacttctcggttaggtttatctgaccctgaaaccctactctgcccacataacttgctgtcccagagtctcaggcatctcacaggcactacagctggagtgtgtgcaaacagctcttccccagttcctgcaggattctagccccagagaggacttcctgggggacagcccatccagcaggctggaattcagacaaagcctggcacctgactctcagcccagggcatcaagcctctgttaccagcagttccagaagctgtaggcctcaaaaaagtgaaaatgcacattgtgttttcactcagtggtctcattatgacttactgattcagaaatctcctttatttgttgagttatgcctgcccctggggcccatagcactggaaacagagattgtggtttaaaatgttgaaagggaatttttaaaatataaaatgaagttgaaaaaccggaaagcaaaaatgattaaaaacaaaacaaaaagaaacgaacttatttattctagttaagtgtacttatggatgaaagtgatctctagccaccagatgatggtgtttgacaacgtctctccttcatttattaagaatgtgtttactgcacacctactatgtgccaggctagttgaagggattaagaaagtgctatcaaatgtgatactcatgtttaaggagtttgtcaatttagtggagacagactgtatgcagaagcaaaacttccaaatctagaagatggggaatagagggctttgtgtagtgacatgtgaatgaggaattaaaaatgagtaaggtttggccagtgcacaatgaggaagtctttccatcagagggaatggctagagtgaaggcagatatcctgaaaaaagcaagcaccgtgggggagctgcaagggtctcctgtcctgggaaaacagagtgtgaggggaacagcgatgggaggggagacagaggaggcagcagcgggggtttcatttcagaaggctctccatgccctgtgaagccatgaagactcaaggaatcatgctgggctctgcagggcagcctaatacagtgtttcttttctgggacagtggaaaggtgctttattatgatgtaaccaaaattcatgcctacacagctaacttatgtcaagtgagataaacttttaatataagacgtgagatatggagctgtgatcagatttggcttcaaatcttagctccatcacctagcaagtcaattgatctctcttagctttggtttccttagcaaaatggagccaatactatatggcatgagaggattaaatgagaaaacataggtgtgaaaagtgctaggacattaagaaatgagaggataagccacagactgggaggaaatatttgccaaacacgtatctcagaaaggacttgtatcaaaaatacacaacaaactcttaaaactcagtaagaaagcaaatgacctgattaaaaaatgggagaaagatctgaacagacacctaatcaaggaagatatacagatggcaaataagcacatgaaaagatgtttaacatcatgtgttattaagaaattgcaaattaaaacaagataccactacatacatattaggatggccaaaatccaaaacactgacaccaccacaggctggggaggatgtggcacagcaagacctgtcattcattgctggtgggaatgcaaaatggtacagccactttggaagacagtttgacagtttcttacaagactaaacatacacttaccatactatatctagcaattgtacttcttggtatttacccaaatgaggtgaaaacttatgtccataggaaaacctgcacatggatgtttatagcagctttacttaaaactgcaaaaacttggaggcaaccaatatgtccttcaataggtgaatggataaacaaattgtggtgcagacggtccctcacttgggatgattagacttaggtttttttgactttatgatagttccaaagcaacatgcattcagtagaaaccttaatttgagtacacatataaacgttctgtttttaatttttggtacagtgttcaatcaattccctgacatattctacactttattataaaatgtactttgtattagatgattttgcccaactaatcatctaatataagtgttctgagcatgtttaacgtaggctaggctaagctatgatgtttgtcaggttaggtatattaaatgcatttttgacttatgatattttaaacttatgggtttatggggatataacctcactgtaagtgaaggagcattcattcgatatccatacaatggcctatggttcagtgagaagcagaaatgagttatcaagctgcaacagacatggaggaaacttaaatgcatatttctaagtgaaagaagccaatctgaaaaggctacatactgtacaattctgactatatgacattctggaaaaagataaaactctagacacaggagaaagatcagtagtttccaggggcttgggaggagggaaggatgaataggtgaagcatagaggatgtttaaggccgtgaaactattctatacaatagtgcaatagtagatatatgtcattgtacatttgtcaaatcctatagaactgtacaacataaaaagcaaacctgaataaactatggactttagctaataataataaatcaatattagctaattgtaatgaatgtaccacactaatgcaagatgttaataataggggaaacagtatgtgggtgggagggagtacatgggaatgaggtactttctgctcaacttttctgtaaacctaaaactgctctaaagaaaaatgctaggacaatgcctggtacacagcaggtgcttaataaatgatggttttggggctgaatgtgaggcaggcagtgagctaatagcagagatacttagaaacttggtgctctccacttgacctctgtaccaaatacagatccatctatctgcagaggcaaagaactattgtgtgtgttcactaaagggtggaattcagctgtaggtccaccacaaaggcactgcaaggagtggcagtgtcctcatggtttatttattccttttgggagatgctaatattattctgtgtccccttcttcttctaactttatataattagaaggataaaaaattgtgtttacccacatgcacatggagaaagatggggcggcaggcgatgtgaaggcgtttatacgaggtaatttacaagcagcctagaatgttcattatgctctatctacattttgcaagcttgaaaaacagctaatttggtactccttgtttgatattcaagacaaggagaggagttaagaagagtcatgtggaggagaagcaaactcctcaatgaggcgaggggaaggtgcagcctggctcccccggctctcagttgaggtgagagatgggcaagagctggctgtggcgaggagggaactggtggcagaaggtagaagggagacatggtaccaagacacataaattcaaagagctccctttaacacaagtctaggggaacatcatcactcagtttgcaatcaatctgctgttccttgcttgaggtcaaagaccactagtatgctggtaaatgtttaacatacagctccctgtgggaaaaaaggccctgatcagtaatgtctgctgatttctgtggtgtaaatactcccaccatgaccgatttcaagctaccaacatagcatcaaccacctcacaaaattcctgaaaatttaacaatctgcttttgcaagctggtatgagtcagctacagaacaccactgacagaggacaaagcctagcacaccctgcaatgtcttgcatgatctgatggtttgggacctacttctctctccagcttcacatactgctctgataactgtggtcttctttcagttgctcaaatgcactgtgttcactctgaccacagggcctttgcatgttcaaagaacacctccatccaagctggcagttgcgcctggatcctgggctccaattcttcctctcctcatagctgacccctcaccacacctgtagacccagcctatcccttccaaagactggcagccaattcttgcctttagcagaagggaggttatggattgggtggagtctgaaggcagacctgaggcttgtcacaccctaaccatatcacctggggtaggttaccacctcccctgagcctctgtttacccagctataacatccaaatcatatatagctgtgcagacttgctgcaaggattaaaagatgtaaaatatgaacccacctggtatgttgtaagaaattaacacaactatataaattcagttttgtttttattctagacctgggccaatggcatcagcagcacctgggaacttgtttgaaatggaaattcttgggccccagcccagactcactgaatcagaaactgtggggtggggcccatcaatatgcatttcaatatgccctccaggtgattctgatacacgttcaggtttgagtatacagaccaatgtttagtgacttagtgcagaggtgctctggttattcacttcaatctgtcttgggaaagaccagaagatcttactggaaatgggccataagactagagactcaccttgtgccaggtggtgggatacggaaatttagctgtgtgaaaagtgtaagatgttccaggcacttatcaaatgccatggggatgccatgccatttgattctcacagtaaccctgtgaggtctataccatcatcccatttcatgaatgagaaattcaaggctccaaaaagtttaataactcaggagaaggtatagggatgagggcttctttatagagttgtagggtcctcactcctcctggaacgctgagatccatgacctccatacccttctatgccacacttctccagcttccactttcctctaagttctcagtctccaacattggtcctcatcccactaaggtctcatggccacccgagagagagggttcactttcctctttcatacagttctaactctcagaacaaaccacaactccttctccctccctccatcaccaaagatagcccagtaaacctgtcatctcaacccacatccacttaaagagagaatcacttcaaagaggtggggctggggagagaatattatttggatacttgatattctttcttcctgtcttctgggcactacagagggtaaagaacagtgctttttttttttttttttttttttttcagagaaaagagatttgactcattacaatgaattgtggagctgaaaaaccatttcctacaagtattggaaatgttaatgccatcatcttgcaaaagtggataaggaggaggcaggtaattctgctgagactgcctgggtacctcactgaagctaaaggtctgcacattcaatcttgattgaattaccattatcaagagaggctggcttgggcatgatgcagagacagcccgacattctgtgtacctccttgtcctgccagatccatgctggctgaaattggaaaacgcccctttgtggggtcctgggaggagctgctccagtagatgcaacctttgaggggactgaaggggactggagttgagaggggcaagcaccaagagaggaccacctgtgtcctaaggatgccatccaggcactgccccactgaggggcctttctgaaggaagggagggaggtttcttatttggatttcttcaaaagaagaacatgagatatgtatttggatgcaagtagttgttgtcggggggtgatcccaggaaacaccagcaggggagtgggaagtgagacagagaaagaagaaatctaataggggtgtgtcattcagcaagttgccattgtagcaagttgaggcttaattcggctgaggagctctgggagtcattctacctaagcagagagggagctggggtatgtatatacccacttccatcagtcattaattgagggcaggttctggggacatttaatattctggctctttgggcctgccctgcaagaaggcagagaaggctctagtggccagaaaaagtccttaggaaaagaagcaaaggtgctggcaatttgaattagcactagcacacatgcaagtagtgagtgtttggggatatggcagggtaccaatggtttctgcaccacaaggcatctgtaggacccaggcaatggccaccctcagagacagtgaagaagaatggaggctgagagtcaggagcattgaataaggcacccactctgtcacccccagctctgtctccccaggaatcagcagagaaacctgctgtgaaaaaagtcctctgggttttgttttgaacctgagttcctcactaggagtgagggtcctctctgcactccatagccccacctccttctggaaaagatgggcctctctgaagagctcatctgctctgaggttgggccttagcaacacattctcccccaggaacatggatgtgacttgatgcagagaggactctttggtaaggaatatgtgccaccctaccctggcaggcaagagaccacagctctggtcatggctgttctacagacttgctgtgtgctctcgggcagggcacagtccatctctgggctctctcttcttgcctgtgaactcaaaaaggctacactaactcatctagacttaaaagtctgtgacttaaggggccacacaagattcagatttaataatcattcagcttaatttggcctctccatcctgagagctgccctagagccatctgatgggtgagaacctgaaggtgggtgaggtgaagtgattgtgctgaaggtaaacaacagaactgggatgaaaacctgggactgcctgacctcatgtctaagaccccaatacacctgagcccagtggcttttcctagattgggagaagataagtctcagaaaatgtgctgatatcctgtgtgcccgcagaccccctctccacttcatctggccctctaatccaggaggctgattgctatggccaagattggacattctcaaagttgcacatgcgtcaccatcacctagagggcttctagaaatacagattgctagactctgtcctcagaatttctgattcagtaagtctggggtggagcccaagaattagcacctctaatgagttcccaggtaacactaatgccactgctgtaggcattatactttgagaaccactggattaggtcaacagatctcctgttctctggattctggttggccccagccaatggaaagcacaggcagaagattgggtggagggaggagagtgtgatggaggtacttactcctccagcaccccttggtggggtcaccatgggtggctgccttgccaccaaaggtcgcacccacctctggtcaggtcatctctctttgggtcctggtaacccctcctacggaatccttcctggtctgaggatggaattttggtactgcactatcccttgtagtctttctacatctagattacacctttataaagaactgatcccagaagggggcctcattttgtaacatttgcaacccctgtgatcacttcagcttctcagtgtcagcaccttcctgccagtctaggaagcacctctaaaactttacatggagaatgctttgggattcttgaatttccccttgccaacagtcgctgccctagagttacttggaagcaaaggtctctttgttcttattttacccattcatttccttccctttcacttcctttccatttacactccctagaaaccccactgtctctattactaaattctaaatagaatcacttggaagaaaggagatatttcgccaaggtctcttgttgtttcttttgtaggcagtgccctccctcctacttgtcccctttaatcttttctgttctccctggcctgggcctttgtcctccactccagcctcacagtgctctgggttccttaagatgctaatcacagccagttttcttcttgcgccaagaatatttctatttatcaagcctcggcaggctttgcctttgggagggacgcatacaagggcaggaacactttccattccttggggctgtttcttttttacatatcccatttcaattccaggttgttttttttccatttccctttttttcttgattctcctttatgtcttgcgctgctttctgaattcactggttacctcggcactgtcttctttcagcactgaatgcagacctgctcttgccctgatctcttgcagaatgattgactcttaaattagaaaggagattctggtttatttaaacccatcaaggtggtatcgtcaaggtgcttcagttctctctgtctccatttgggttcctcagaagtagatctaagacagagattttagtccaagcagtttatgtaggaggagacaggaataccagtaggaaaggggtgatgtacgacagggaagagaaggcagcttattaagggtgagttttcaagcccattaggactgcaggtagctgtattctcatccctgtgggaactccagaaggaacttcaggagaacggtgaagaagctggggtatttcatggtggagggcttctcctgggggtattaacccttcaggatttgcaggctgcctgtgcctgggcaggggatcctttcccagctttggagaaagtcctcagtctaagagatgcaggcagggcagggctagggtgaagcaagctcagagtctcaggcataggctttatcagataagtgactatatattttagggtacagtgtccacagtgcaggagcagagaatgctggggaccagacagggcaagcagctccctgtggcagagtgggggctccccaggagcaggagctccacctcccagtgcccatcacagggcctgctttgaggaggcccacatgtcataagtcttaatacatgtttgctgactgtttgaatatcacttctcaacacttcacttgcaagaaatcttgctgtctgaattaccatcttccaagagagaaattataaatgttttctgattagttctaccattcatagcccattcctaaatcagcacaggaaacagctaagctaaaacttctgcctttttcttcctttacaatctgcctgtatcttactctttcttcctccaagttttttcttaggcaatgtctagacagttaaaacaaaacaaaacaaaacaaaactctgaattgtgctagaaataatttgtcattcaggatcctttttttttttcttttggatgaactgggttactctgtgagctgagacccagggatgttccccacaccattggtgagatgtcaaaaggtccaggttggttacactgagtcagacaaaggctgttgtagactcctgttctaattagaatacatgcttagcattttgcacgagataactttgtcttctctgtatttattttactttgaaggctgtacctacgaatatttggcagtgacaatacttgtgtgttacctatgcatgacattcagttctgtggcagtctctctcttcctcaccccccagaactgaataccatgcacctgtcacacacaagttattgtcactgtttgttcaggccccatcatcccttggtgagactactgcagtagtctgctgactgatccctctgctaccagcccttcccaatcaagtataccttccatatctgctgccctagtgatctttccaaaatggacatctgatcatgcccacctctccccaaccaacctgccttattctatgtccccacaggacatgtcctgagtacccagtgaatcctggttaataaaataaggtggaatgatagatccatgctgctcaccagtgacctcaagcaagtacccctgtggctaagagtaatggtgccaggcactgtagcaagagttttatgtacctttaaatgctcctcctattatcctcatcattgtaaaggggaggaatcaaaagtttacagaggtcaagtaactttcccagggccctacagttgggatagaaacctgggcagtttgactcccgagggcgctaactactctgcaccgctgacttcatcaatgagtcattcactgggggtgcctacaggaaaggtaaagctcattgttgagcaaaggcaatgtccttccttagctctgcgtaacatgccttcccctgcaggctcagtacctcccgaggtgcactgatgcagacctgagggcaggccctcacctcagagcccctgccctactatagtggggacaggtagaatctgtgttgccctaaactctgtctctcatactataggagtagccccgggctcctgtgaggcctgagctgggcataccccaagccccaggtgtatgccagagttactggcttcttctgagcatcagcctttacttccaagcatcagccagtgtgactccaccttcttggaggagcatcattctcttgcccgggttctcctagcccctccctcacaggctggggcccatgctcctcaccccaggttgctgccaaagtcctcctttgaattagaggagcttctgggaacacagagctcatctctttatccagctgtggggtcttccgcatgtcagcccttttggctgggcttcttccccgacctgaggaattgagcaggcaatgctcggtgagacccagccttcagaggttcttccccaagaggcttcatggttctgctctgccctgacccatctccctgcctgctccctctggctgagatcagccatgctctgtcatccagtctagggatggcagtaaggctgatataaagcttccatcttggcatgtagatacaaagctagagacagcaaagattatttgataacaaattccaggtaaataatagtaatagcctcttttcccctgcatcctcaacacctgaagcttaggagctcccagaagggcacctacaggatatgatgttcccatatcgattcttattgcggttttcatcctccttggctgtgtcccacgaagctgtctgcccctctggtaaggcctaaaaagcaaggacagagtggttagagtggcctgagataggagctttatggaagtggagatgaaccaacagggcaaagtaagacccactgcgatgggactcctagtggaaagggatagatgtccttggatggggcctggggaggacatagattttgtctgtccctggacctattctcttgttcattgtttcaaatgttattgatgtcttctgtgtcatgagttcacaatctagcccagtgggggaatcgcttgtccattcattgaattattcattcatacactcaacagatacttactgagcccctaacatgggctgggcactgttttaggtactagggatatagagaaacagacaagttccccttgagcttccagtcaactaggaaatatagtaaatgtgtaataaaagagtaaatgtgtaattttagatatgaaaaatgctatgatgaaaataaagcagaataaagggatagtgatgaggaatgagaattatttcagattatacactctgggagggcttctccaagaaggtaacattttagttacagtagtcctcccttatccttggaggatttgttcaaagaccccccagtgggggggctcctgaaaccatggatattaccgaaccctatacatactatgttttttcttatacatacatacctatgataaagttcaatttataaattaggcatagcaagagattaagaacaataataaaatagtatgacaacaatatactacaagttatataaatgcagtctttctctctctctctaaatatcttaatattttttgactgagattgaccttgggtaactgaaaccatgaaaaacaaaactgcagataagggggacttcattaatgatagatactataattccttcatgatactgtaattccttaatatgaaacagccagtcacaccaagaaaagtagaaagtgcttttcaggcagagggaacagcagatgcaaagatggtcaggcagcaaccaaatgaccatattcaaggactggagtgttgtgaagagggaagtagtgatggaagtatctagagcggatgggggagtccagattatataagacattgctattactggttaatgaactgggcattattctaagtgtgatgaaaaaccatcagagggttttgggcaggggaatcatctgattcatgtattacaaagtacaatctggctcatgtatggaacacaggctctgggaggggcatggaggaagcagggagatctgctagaaagttgtggcagtggccaggcgcgatggctcaagcctgtaatcccagcactttgggaggcctaggtgagtggatcacgaggtcaggagatcaagaccatcctggcttaacacggtgaaacccagcctctactaaaagtacagaaaaattagccgggcatggtggcaggtgcctgtagtcctagctacttgggaggctgaggcaggagaatggcgtgaacccgggaagcggagctggcaatgagctgagagcacgctactgcactccagcctgggcgacagagcgagactctgtttcaaaaaaaaaaaaaaaaaagttgtggcagtactccaggcaacacatgatggtaccttggactcttagaccgtggtggtggacatatgagaagtgattatttgcaggatgttcagttgaatgttgttgacttgggttgcctcggaagcagactcagagataacaagtcaggcacaagtagtttgtttgggaggcactcccagggagtttgggtgggagaatgtggaagtggcacaatcaagggaatgaagtcaatatagagcacatcaatgagcaggttaccactgtgggcaactggggcctaatccaatgggcacatctcatgccttagagttatcccaccatggggttggcacaaagttggggtagttactgatcaattcgcatccagtattggttgaggacaactcttggaaactccccagcatttcttccatgctctgtgggcagagtgtgcatattcttctgtcttgaagaagccctcaggcaaaaagtcacaggtgcttacaggaggaagccataaggtgggcatgcgtgggaacagtgagtgtagagtggatgtgtgcagggcaccatctgccatagatcctgactgtgaaggaaggagaggaaagaaggctgacccttagatcattagtttgaagaactgaggggggagagatgtgatttattgagatggagaagcctgggttagaaacaggattggggaggtaagaattaagtgttgtgttttgggtacataaagtgcttagtagagtgcctagcattgaatactgcacacttttttaaaaacatgttcaaaataacaaaaatggcagccacgttggagatgtccattagacatccaagctgatgttgaataggaagttggacatggacacccagagcttagggatagggaagagatagaagtcatcaatcagtttaagaggatggcaaccaccgataagacagacaagtcaacaaacatgagacaatttacaagagttatgagtcaagtggtatggaaacacagggaagggtgcagtcagttatttcacagacagggaggacgggcagttaagggagtgggaacagctatagaaaagctgcagaagcatgattatcagaccatgttttgattactctctctaccctaaatttagtagaataggctgaacatcctgctcatgccctttcattgcttctgagactgaatttgtaacaccttcagtctacacagctctctgtcagcagtgcaggaggagaacccaccattcattttaatacaccagccttgcctttgcccatctattccttactaggtctatcctaagcaaggaggaacctgaaccaggttgatcagaaattcagcccctcaataagccctgttttattggcaggttcttaacaggccagtgctcatgcatggttctacctttcttgcatctggtctctcaagtgttaagtcaacctgggtgagtcttttcctagagttggagttggaatgctttttctgtaatgggcaaactagaaagaagtttgggctttgttagttgtgtagtctctgttgcaacaactcatactcaactctactgttgtagagtggaaacagtcacatataaaaatcaaacaaatggtcatggctatgttcaaatacatctctatttacaaaaataggtgttggggccagacgcagtggctcacgcctgtaatcccagcactttgggatgctgacgtgagtggatcaagaggtcaggagttcaagaccagcctggtcaatatggtgaaaccccatctgtactaaagatacaaaaattagctgggcgtggtgacacatgcctgtactctcagctactcaggaagctgaggcagaagaattgcttgaacccaggaggtggaggttgcagtgagccgagatcacgccactgcactcctgcctgggtgacagtgagactttgtctcatagatagatagatagatagatagatagatagatagatagatagatagatggatgttgggctggatttagcctatggctatagcttgctgacctttattctagaagcatgactatgatcctcatctatgcagtggctgagtaggtggaattagtgctcattctgctacctagcaactgaagattcattagagggcacaggaaggagttcctttcctgggcttctcaggctgagccatgttctacaacttagcctttcttaggttttagattcgggtaataaagtgccttcctagctattaatgggtcataattttgttctttctgtgtccaacgcccttagacaaacatcctggaagagaagcaatacaggtgctaggttttgggcaccaatctctgacctaaatctgggtatggcaaaaatgttataaggataggtaagtgctcatttcacaaatgtggggcttatctctcacttttctcctcttgttctttctccttcttctccttttcgtatttctcttcttgctcctcattctaccaaaccttgcatccatattgccaccagtttaggccatctctaggtggaagatgcttctagctactgcaggtaactcttagaactcagattccagccctagcctcctcttctatcccagccaggtaactccatctcctccaggcaacttgccaggtctgttctctgtatgtgaagggaggttgctgctctcagtggtagcactggacttctggatgtcaaagctgatctattgagggtggattttgtacctgaaaccctctgtgataaaagccaattgttcaaccaaacatgtccccctgaaagtggggtgaagccaaaagcaggatagcatgactgttttcatactaattttttgaaaaaataattgcgttgagtacttgccatgtgccagggtttgggttaccattagcttaaggtctctttatgactgcacattagaatcacctgggcaggttttacaactcccaaagccaaggtccttctcaagaccaatgaagtcagactctctggggtgggacataggcattggtagtgtttaaaactccccagctgatgctactatgcagccataatttttgcaaatagtgactttaaaatattttcccatgagtctcctcattggttccttttgttttgggtttgtcccctccaatccattctccactgtaatcagaaagatctttctaaaatgtgaataggacccagtgattcctcttgccattgccttcaggataaatttcaaactctttagtgcaacatccttaatgacttcaccccaaatgcccctgcagcatcacttcttgctcttatatctatcctaccagttataaggtgtttaaaatttataagacttttcgcatgctgttccctttacctgaaattcccttccacctgagtccgtctgacaaactcctacatgtccttcaaaactcagcgtaagcatcttctttgtggaatcttctctgttcactctccctcaccccactgcatccccaggtaaagccagttacttctattattagatagacttctttgcatctaataatttaactctatttctcaacttggtcataggcttcttcaaggaaagggtagcatctttgtcacgactgtatctccagaacccgatgctggctctatacttcagatgtgcttgaaagacctatttaggatgaatgaatgagtggaataattagtgaatgaggtggcttctgtgctttcagagggcaaatatcctgggatcttagaggtgtcagtgaccttgaaaattgcctagttgtgttcccatccacaatggccttccaagcagctgataagtggatccatagcatctatcacttggataacctccatgacagatagctcaccacttctccaacttttggcctcacttttggacagactcaccagagttttttctttactcaacctcactgcactttgcctatgccatctcatggggccccacagaataaatgtgtgccctttctctgtcctgtgacatcctgcagagatttcatgaaagtctcttgtattcactcccagaatccttgaatggcagtttggggtcctctcaccatcaacaaacaccatgccttccaggagacaccccagcatgcacctatccctcaacaatcctaaaccgaacaaaacagttgtgataagtgggtggcagttcgtgggaaaccacacaggccctgtcatggtcctgggagcctctgtctcccttagtgggggctgaaggggaccgagtaggcctgggggctgtgatgatgttgataaaagcagaggagggatgcctaatagagcctctgggagggagtggtaatgaccccgtaattggcagactttgatcacacatccatttccctttttagggagctacaatctaataagggataatctcttgaagcaaaaaaaatatgagggggaaaagtatgaaagagagactcatttccatcttcaaagtgagcaagctaagggcattatttttccattagtggctagttacagtagattgaccagggaatggtggcagtcattaggcgctaatcacattcttttgaaaccaaaattgccatctcattatattcatccattatcaatctccgctttccttttctcattctcttctcctgagagtgctgggccctatttttacattcctctctgagtgtggaaatgtttcctactcttcaacagtgttgtttttccaaggcagtcattttttttttttttttttttttagttcaaaagatgtatttggggatgtccttatccctggagagctgcgccgtggtatttatagaatcctcaaaagtcagatttggaaggatcttttgagaaaattattgactcattttatagatcagcaaagtgaggtcctgagacaggaaatgacttgcccaagaatatacattgagtctgtccccactccctccctcactcacttccttccttccccagtgaccatctggatgccaggtgctgggatagacagggacccgggcaagggactagatagggtggtgtggggagaactctgaaaaggggagatctgagagggagaaaagcagcccctgaattctgggagctgacctggcactcacaggtaggccttggtgctctcctgctgaacgtggacaattgcacggaagaccaaccacaggcaaggccgctctgaggccacgatggaacaagacaaaagcaagttgtatctggatgcagacaaagatatgaacattgtccaagccaaaaaaatgaccaaacacccccatattctggttaatatgagcggcctgattctttgccaattacagctctagcctctatctgatcttcccttcttataggtaagatgtattaagatatccaatcataccacttcccagtgtgtccaacctaaaacaaagcctcacctccttagggcctctttcaaatcagcaaacacagcccacattctgagtccttcctaacatcctcttcctgaaatgtcccacaggaatgcacacttccaggtatgcattcacttcattgcaacaagtgataaacccaacttgttcacctccaggaggtgtgtccctgctgatctctggccaatacatttcagctaaaaactaaatgataagcagatgccagctttggcgagagctggggaaggaatgttccattcagagggaacagcaagtgcggaggccctgggatggaatgagctttttgtgttctagagcctctagaaagggaggctctccagagcagagagaataagaggaggatgacaaataatgtggatttggcttggggttggggcagggtgttcaatcaaggtctcgtggaccaaggacaagaacgtgagttttattataattcaatgggaaagttttggatttttttttttttttgagatgatggaatttccctcttgttgcccaggctggagtgcaatggcatgatctcagctcaccgcaacgtctgcctcctgggttcaagtgattctcccgcctcagcctcctgagtagctgggattacagtcctgtgccaccacacccggctaatttttgtatttttaatagagacggggtttctccatgttggtcaagctggtctcgaactcctgacctcaggtaatctgcctgccttggcctcccaaagtgctgggattacaggcgtgagccaccgcgcctgacccagaaactttttaagaggggtaggctgagctagtgccagcatcatgataaatggcagacagtgcttgtcactggaaccttctttatccttgatgatatgctttatagattttagaataaaattatcatctggtacccgccccagactaactctccctgcgagtgcaacccaccctcctatccacagagctgagcccatgggaggctcagaccacatgaccacaagtcacagacttcttgtgttctgctgtgctgactcagtccataggactatgaaacctacctcaatgtcccacttagtacgttcattttctgctagaactgagaatgatcgctgatgcctgtgtggctgattttttcttctacctggttctactgagccaaaccaacagaagcttgccatccttctttagacactcttctttgcacctaagcccttctgagttatgcctaaaatagtaagatgtcaaaacacaaagcttcctagagcagctcactcccaattcaaggctgagggcgtgtcagcccatttcatttacccatttacctcctatcctcagcagattctgtcatttgcaatgccccccttcactctcctttgcttgactgtatccctggagataattggatatgttatgccctagggtgcagcaaaaccaggccagggatcgctgatgaggcagttcctggctgatgctccagggcacagctgagggcttgccgcctccatgttcagtccagcctgccaggatttctccacacccctgtccaacactgtactctcctggtgcagggaacactctggagagtcttcagcaaggaggcaccattttacctgggtctttccttcatttgtcttgtcaagaaatacacttgcacactaactgtgtatgcgagtcagggaaaaggcagagctttgcaaaaggcagacagactaaaatgtttgaatatttttactgcaaataagttcaccacttcgagtgtcaataaacgtttctgaaaagagtcagtaatacatcctgaaggttatgggtggggaaggatttaactatacagaagtaacgcaaggtaactttttggttgatgaaattctcatgtgtcctgattgtgttggtgtttaaacgactctatttattaaaactcataaaactgtacactctcccaaaactaattttatactatgtaaattttaaaaaatggaaaataacacaccccacggaattttgtgatgattagtgactacccgatacaatacccatagcacctggcacaatgcctggtacacagtaggtgcccagaatcttccatcttccatatcctctttcccagggatataatattgagcctttttggtccacttgtagaaatcattctcttgccatcttcagtcaaaaacatcaaggattttttttttttttttaattttactttaagtaagttctgggatacatgtgcagaacgtgcaggtttgttacatagctatacatgtgccatggtggtttgctgcacctatcaacctatcatctaggtttcaagccccgcatacattaggtatttgctctaatgttctccctccctttgtccccacccccaccccctgacaggccctggggtgtcatattcccgtgtccatgtgtcctcattgttcaactcccacttatgagaacatgtggtgtttgcttttctgttcttgtgttagtttgctgagaatgatggtttccagcttcatccatgtccctgcaaaggacatgaactcattcttttctatggctgcatagtattccatggtatatatgtgccacattttctttatccagtctatcattgatgggcatttgggttggttccaagtctttgctattataaatagtgctgcagtaaacatatgtgtgcatatgtctttatagtagaattatttataatgctttgggtatatacccagtaatgggattgctgggtcaaatggtatttctcgttctagatccttgaggaatcgccacactgtctttcacaatggtagaaacatccagtttcttttttcttacaagggcaaagatgggaaatctctgaaacatctattctggtttgcctcagaccaaagggattcccaggatgtaggactttcagttttaaaactgggaccgttttgggaaaattgggataagctggtccctctaggtataggtaaaatagcatttagggaatgggaacgtttcataatctgttgggagcctaaggtctggtctctattgtggtccacgggttcagttaacacatttactgatgtcgatggtcagcttgtgggtgacaagggaatcacagctctgcaggttgtgcacaatcgaagagcattgcatctatgggagcaccatgcatacggcagaaattttagggtttccatatttattatgaacattttctggaaggtgacagccaaatatcttgagacaggtgcaccttttgttatttcactctaaggtgctgtaggagttagtggtggccttggcagaggccaagctttcaacaaattccatcttctgtgctgaaaagcacaagacttagggattataaatgtggacagagaaggcaggagaggatgactaatgacgtctattcagagtggcatcaggagagcaaatattattgcataccatgtcactaaatagacagtaatttatgagttctgctggtgaagctaagtagaaaatcagattgcagcaagatgggggtatttgtctgtgacaggaactttgatcaaggcagagaagttgagtgcatgtctgcatgtagactcacaaaacactctttaaaaggcccaattaaaagctacaagttctcctttaggtgacaaattccctgccttcaagaagtctatagcttaatgggaaatctcacgcgagggtacctctattcctcccagctgtgagtctacaatcttggggatccccataattcacttcaggctacagacttccagctgtctacacccgtctccatggtcatgcatgagcttccgggtggctgactccagaccagcaactctcctctaaacttgcagccagctatggtgaagaggcagactgccaggggccatgatcataaccttggtaactgttttcaagaaaactgtgcaacgggtgtaagattcctattaaatctccccaactagtttcatttctcctttcataggcaggcatctttgtttctcctaaaaaaaaattggctgcagcattttaatcatttcgttttttgcttccaagctttgcacatgtagttccctcttgtacacaaccttctcctctacccatcttcttctacttttctctaactcggagtcttatcttttctgaaacttctgatagcttttggcaacaagaagtggcaaaaagcaagtgtgtctccaaagcatttgaactagagttctgttacatcattacatggtgtggcaagaccacgagctttctttaaagcagcatctttattttctttatttatctttctatctccagtgcccagtgttaggtgcacaataaatactcagtcagtgtttctggccagattagtgttcataaaatagaagcatatactatcagcctttagaatttcatgctaagcctgtagtcaaacatttcacagatgaaaatgagacccagagagggaagagtcttgcccaagaccacccagagtctcaggagcagattgaggaccaggttttgactcttggtcaaaggatttttctatagtaccacctgaaaattgctcacttggttgggggagatcctgtattaaatacacaaaaaacccaccatgtgctctgttagaaacaatattgtaagtagaacaataaaaataggctaaaagggaaagactgagtctcttcccttttcccttaatggggaatctcacacgagggtacctctattcctcccagctgtgagcctacaattttggggatccccataactcacttcaggctacagacttccagctgcctacacgtgtctccatggtcatgcatgagcttctgggtggctgactctaggccagcaactcttctctacacttgcagccagctacagtgaagaggcagactgccaggggccatgatcataaccttggtaactcttccaagatcctagatccctccaagatccttggtaactcttccatgatcataaccatagtctcttccatgtgagctctttcctgctggaaaactctcaagtttgaaaccacagcggtcactgatggcttttggccactccctataatggcctattgtcttttttcaatctggaggtggggtggagtggagtgaaacgagcaggtggagcccaggtattcctgttttggtcattatgagttcccagagttgaagaaccccatggatttcccattcatgatttgggcgtgggccagtaattcctcatgcccctccctagaaccatgctcatctgcaaattgaggagctgaaccagaacctttctggggttgcctgtggtgggatattctgtcatcactctgttaccaactgaggagaacaaaccttgtgggagaagcagaggtgtcctcagacactgctcagggggctctgagcagagaagggagcacctggggtgacctgaaacttccatctctatagttataccccattcaaaagctgcctgcctgccatcaccccatcacccacagatgactaagaacaagatggcaacacaggccttccccacaaaagccatacatatggtgtgtccgtcctgagctggaaaatgaacaaatgtttgctcttcattaggctgcatcatattcctcacagctgttccttgttgctttaaatagtcttaatggagctgtaataaccagtaccttctggttgccctactgggctggttccattcattatggcgacagcctgtctggattgaactgggatgaatgtgcttcttccttctctcccatcacaaagtcacctcttccaattctcccttttcttccctaaacctgctgctcttctgactaccatggcagcagttacatgggacacagataactcggctctccagcccacatctcttatattttgctgtgatgcttagggttttgctgtgtaacaggggaaggtgggagaactggagctgggggggaagcaggctggggaggagggaggatgctgtggttcagaatcacatgctcttgactttaataggaagggtatatggttcagaatcacatgccctttcatcagcaggagtagacctgagggttggcagagcatgccaggggatgtgtgtgggcacatgctggggactccatgggttttcttagtggttctcagctttaaaagtatattcacatcaaccggagggcttagaaaacactgaagtatatatcccacccccagtgattctgaaatgtggctgtacactgaagtatacatcccacccccagtgaaactgatctgaaatgtggcctgagcattggtgttttttaaaacttccccaggtaactctaatgcgcaacccaaattgaaggcctctgactgaggctcagatctatctggcaggtgaagttaatttgtcttgggcctccttgagctcctaggagcccaaggcccttggccaattgtggtttttagaacttgagacataaccatggaagcggcagccccagatagtgaggtcccatgcgaccatcagtgggagggaggcccagctggctcggccaattggttcttatttagactcccagaatatcagtgacagaagggttatttggatcactttgacaaacccctttgctcccactgcataaatgtggaaatggaggcccagaggagagtgacctgcctaaggtcacctgaatacttaatgaatgttataggacttgattccaggcattttgactcttcaattcaagatagttcatacattatttcaaataattgaacttaaaatatatattgagagactcaagttttcatgccaacgagaacaagctgattttatggctctacatgcagaaaaagtgcgtaggcttgtctgggctctgggcccagtctcctggtttgggcagccccatattttccttgaattactgtcccagccgcctacctgcctctgttgtccctgctctgatctctacaagatctaaaatgcaaatctactttagaaagtcctgctctcttcgatggctccagtggcttcttgattacaatccaaagtcattagtgtaacaaacactcatcttttgcttcatcctggcccctgttgacagtttcagccccatctccctccatgcttcctcccaaaccgtttctggttcccctcactcaacctgctgtgcccacccctgtgccatagcttatgctagccgctctgcctggaacgcccttcccttctttaatttggttcttcctacttctcaagcttcggttgaggcttcatgtcttccagaaagccactggctatttacctttaggctgggttaatgcatcccacccccaaggattctcatagctctggatatacctctatggtggcattttttggctctcagaataggctctacattccctagcaggcaagggctctatttagttcccagagcctagtacagtgtctgtaccctggaaaatgctcccatatcttaaagttgaaattctgaaaggcctggtcctaggtccttgtctctgtctatactcacttgcttggtgacctcacccagtcttgtggctttaatcatctataggccaataactcccaaagctttctctccagcccaggcttctttatcaaattccaacttcatagatccaactaccttcttgccaccacatggagacactaatatgtctaatggacattgcaaactcaatttaacatgaaactactgattgttccagctctgctttacttgagcatccccatttccattagaggcagctccatcctaccagtggcacaaacaacagccttggagttacccttaattccttttgtaacatacaccatgtgttaggaaatgctgttggctccatcttttaaatatattcagaatccaaccacatctcaccacctcctctgccatgccctgagtcatcgttgtctgtcacctgggttactgcaatgtcctcttaacttgctttcacccttgccttcctaagttccattctcaacacagtagctagaaggaagtaaggtcagatcattagcacttgtcttctcaaagctctgaggtggctttccattttagtcagagtaaaagccaaagtccttataacggcttgtaatgcatagcatggtcaggtccctctttatttctccagtcgaatctcctattactcttatcccttgctcactcttcctctgccaccctggcctctttgcaactgcttgtacatgccagatatattactctctggatctggaactctcttcctccagatatcttccaccatgtctatattccaagtttcgtcatctaattaaggactatccttttatcctttttactattggaacctcctctacttcatgtccctggaacaaatctcccttccttgctctattctttctttttccatggtacttgtggcagactgtattattatccaaagattttctttttctttttttttttttggagatggagtctcactctgtcccacaggctggagtatactggcacgatctcagctcactgcaacctgtgcctcctgggttcaagtgattctcctgcctcagcctccagagtacctagggttacaggcacccaccatcacgcctggctaatttttgtatttgtagtagagaaggggtttcaccatgtcggccaggctggtcttgaactcctgacctcaggcaatccacccacctcagcctttcaaagtgctgggattttcttccccccccaatatttcttgctctgcatgctcctctagaatctggcaactgcccctcctcctcatcaagggatagagtcaaattcccctctcctagaaagtggggagtttttacctgcttacaaccaatagtacatggtaggaataatgcagtgtgatacccaagtttgggccacaacggtgatgcacttttcaccttgttatctggggagctcacctatggagttctgagccaccatggaaatcgtccacctatcccaaggctactacactgtgaagaagcccaggccactgaagaggccatgtgtaggtcttccagtggacaatcccagctgaaagcctgcatcagtcactagacatgtgagtgaagacatgttcagatgattccagcccccagccttggagacttcctagccaaggctctgaacactgtgtagaagaaacaggttgtccctgttgtaccctgcacagattccacagaatcaatgaatgcaagagattggttgtttcatgttgttaaaatttggagtggtttgtaacatagcaaacagtatttctcactgtctaacacactacattatataatttgcttatttttttaagcttatgtttatttcctatttccctttctagaatacaagcttcagaagggcaagaatctttgtttcattcactgttgtatcctaaatacctagaattgtccctgggaatagtaaatagtacatatttactgaacaaattttaagtgattattcaactgaattgaattttgtcttctgatgcagcttgctatggctgagatgtcccttagatgtcaacttgtcaaacccactcatgtgtatgaaaacactgaacagagcagagaagtgacaggcaacaaacagcacagagcaggttggtatgagagtagcactggaggctcaggagtcttttatctgcaataggacaatgattctcctagcagatctgtgactcctatgctcaggaggattaccgagatatcacaggagccttgatgatcaaagcaatccagctgtattctgggctggacattgcgggctagcacattgtgaaatgacttttatcaggcaatattttccaattaaccctcagttaatcagaaaataatgttaactagaagctaagctttacagcttgctgattaatataatttggactaattgaggccaaggctagcctagttagatttctggttgagattcaaatgatgaaataacatgtattgtttgttttctcattataaaagctgttcatttccatgctagaaagtttggaaaatacaaaagggtacaacgaagaaagtttgaaaagcaactcaccacacagggatgaatgctttaaaagaaatattaatctagaacgaaatgcatgaaagtagtcaaatacacttgtaattctgtcttcaaatttcagattgcaagttcttacatatgtgtttctcagcatttggctacttgtccctttttttttttttggtaagccacatatctcccttaatgatatttgaaatttttaatcaaattgttatgactaatgttgaatataccatttcctttctttcttttttttttttcacccaaacagctatttattatccacctcccatacttccagtttcttttgggagatatgccacctggaggctgttttcccaatcctatgttgccttcctcactttcttgctaattattaaaatataacccatcctctgaaggccatgctgtctatagaatcttgttttttttttcttggatatatggcttgaaaatattttctttttttaattattattatactttaagttttagggtaccaaataacataatcttcctgacatttgttcaacaagcaggtctgcatacacacacagaaagcatgctcacatgcaccctatgtcccagagactgggaccattcaaccccctaggaaatgagatccagggatgggtagtgatgagatcatcttcttcaactctaattcgaatatcctttcaagatttgtagatgagaatatgaaaagtgctattttacttagaccgtttttgaaattaagtgctagctctcccaagcttgtaattacttacatccattgacataaacatttttgttcttataaatatgtcaaacatgccccttgtcaccatgttttacactctcataaagttttaggaccagataggtcctgagagatcaccttatccaaattcttcattcgactaataaagaattttaaaactcagatagcaaaattctaaaatcaaacagcttactacattggaatccagctgtctgcacccccagtttagcacaatttcatgacctcatacgacttcagaaatattgctttgtaagctctttctcagaatatagtctgagggataaacttagtctgcaatattaagaattccaaatgtgtggagtctgagccaatgagttttctactgcacacagcaaaactgaatcaagcatagctggggcacacgctgcatgtgaagaaaaaaaaaagaacaaacaacaaaaaaaccacaaatacatataactcagaccatggtacacagaagatactcaaaagatattttaggaaagaaggagggaagggagagacaggaaaggaaaagtgaagaaagaaattcttgttttcaaagctggctgcagctggagtctaactgcaaccaggagagttgcagaattattcttggagagtgagctgctctttggttcagaaaaacgtcttaatgcattttccttttattttattttgctttttgtttgtaaaacgtgaggcctaatgggcaggatttgaaacaaaaagagtgagataaagaaagctaaattgttctgcaaaataaaagaggaacgtggtgccctttgtctggatgctgaggggtgggggtggaggaagttttgaagacagtaaagaagactttgaggagaaattagatagagacctgtcaggagaccagaaccttagaaggccttaccagcaatgtagatggttaaggaacttataagaagaacaacgttgtattgagctgctgcctgtcctttactgcagtccttctctattattccccaaacctcggtaacaaccactacctgcaaatcctttgtgttagggatgctttggggagatgggaaagggatgcccagtgcagggtgaagagatggtgcagaaagagggaactgtggtcactggagatgaagcattgccttcgggggatgggagcggggaccagaataccacagaagcttgagtatgagacaagaggtgaccaagggcaagcatgcatgctggaaatcattggcaggggagatgtgctggcttttctacagcatgtgggatgggagcttgagccattctggcatagtgaatggaggtgagactccaaagtgcagaaacgttggaggtaatgaaactttggataatgaaaggggaaggggagagaaacaagagtgaaaaaggatgtcttagaattatttagcatggtgcttctcaaatttaatgtgtatacaaatcacctagtttctggttaaaatgcaggttctgattcagtagggagggatggggcctgagatgttgcatttcctacacgctcccaggtgatactgaggctgctggccagggagccatactttttgtagcaaggctttagtgcccaaataagcctctgaaactatcaggaagtttccccacaggctggtctcttacctcgtattcctccttgaacccgtagccctggcctctcttcatctgcgtgatgtgctgcagcaagtcagccacccggatggcgggttggaactggtcccgggggtagctcatctccacagggtcacaggtgcggtagggatgagtctggatcgtgagggtgggctgggaaagctccccgcggctgccatctgcttcgaaaagaaggaggcagaacagatcatcacctatagaagctttgccctttgtcctccctgtctcccccagcttggcctgaggagggcagagggaaccaacttgggactcaactgatagggaaactgcaaaaggattggagatacactccttccctggcctggctgtgttggtagatctaagtatcaaacccacaagcaaaccaatgaccacaacacatttcaagggcacagactgataaagttccaggttgttcatcatccccgtctgtctcagtccttcgtttagactttgttgggcagaaccactaagaagctaggcaggctatttattgggagccccctcctgtttcggaagcagagaggctggaaatagtgcctgatgcctgtctgcaggggaggagagcctcaggtggcctcaggtactcgaagattggagtcacatgtataattctggtctatttgcctgcatggctgtgacctggcttctctactatttttttttcctttgagttttaccctgggaagaattggggctagtcttggactgccagaagctagcagggaccctgaccctcccagctgctctctctagttatgagctctgccacagtgaccaccttcttgctattgtatagtttccccatcacttaatactattaatccagtggcatcactgaacccactttgcagatagggaagcctgggcctcttccttcagtgctgctagctactttccccgggcctggatgctatgtctcatcgccttcataaaatctctccctgatgtaggatctatattctctcttgataaaaaccttttcatccaatgagttgctttaactgccttctgtcagtttggtcaccctgaaaactgatgcctggtcagattgggtttgaattcttctgttccccttggacgactagaaccaatttcttgcttaccacctccctgccaggcatacattcttgatctctcagggccagtttacctttcccagaaccatctaggcttggtcttcccaacctccttccaaagacatggacagtctatgccccagaccatcttgtttgtggcatgcaagagatgagaactgccagctgcagcagttaatgtgtctcccccagatgttttcagaccctgcaaaacacctatgcaggtacccactcggcctatgccatactcattccctgggaggtttagcatatattcccaattttctgcaacttgtcttttcaaaatccatgtgcccttcagcttatttgcctgtcatgttggaatactccatcagacatggatcctgtgtgtgaatgcacactctacttctcggcagcagcatcggcaagcctgttcctggcaaggaaagataatggaagggaacacctgaccttcctgctttctaggtgaccaacttgtcccagtttgactgacaattttccagttttaacattgaaagtacagctgttgggaaacctctcagtcatgggcacacaggaatggttggtcaccctaatgctttcacttatatctgtggttggagtaggggataaatttttcactttgcagccttctgcctgcctccacctaccaagggaggagaggctactaatctgactggtctgactttgagacactgatggggtcgtacctaattagtaggtggggtcatcgtaggcagagtgtggtctctaaaacttcctaattcagggtggtaggtaaacatctccaaaggagagactgtcctttggggaccagccaaataacccctggactgcttacagaaagatttctaagatttagatttatgcacaagaaagaagggcctaggcaagtcgttagcaaaaccttcctgactgcacagagaaatactgcttactttttctcccgggattttaggtaatagctagtacatgttcactggcattgcttaaatgtaccacttggcaaacatgggggtgttccctttctccatcaaccccttggtttcatgagttcgacttactgagaacccactctgtgccaaggactatggtaggcagtggcaatgcagacagaaatactgattccaccctcaaggcttgactgtctagcaaggaaatagacgagaagaatcaactgaagaaaaaggacagagcctgagagatgaaggcacatgtagttaagaacaaggaggttgataaggagtaaaagctgtgggtagaaatgtcaggggagggcaacactgtaacagatggtgcaaggcagatccagagactgtgaatgtgcaagacccttgaagccagtgtgaacctgctgaagggttttaggaggaatctccttctttaaagactcacactgtttcttgtaggtgtcccagctgtcatgaatagctctcatcgaaggcatccttccagcgaatatcactcctgtgatggtgtgattggaaatggagaggaagggagcacttgtgtttgattcatctagagatggtacaaagctatggcaagagccacagaggtatggatgctgcatacctaaagcttggagtcatgccatactctatgatttctatgaaaggatgagctgagtcaatgctaggaggcctgtgagtatttcccaccaaagctaccatcaaacatggggacagttgtcttcagagacccacagtctcccagaggaacttggggcatgggctgcatgggagaccagctgcctgggaaagacaggcttcctaggaatgggaacttggctttttatgtgtgtgagaaatgtcaaatgtttccaaaaccaaatagctgtcaatatggatattttccctaaacacattgctagacagactgtaaacttggtgtcagcaaaaccaacactggaatggaaaataaatgcattgaaatttaacaacttgtattgctgtaacatttgcaataatgtcaatgccagtgctaatgatgctatgaagactcagaaccaagggattttcaaggtttattaatccaacgggttagactcccctttccaaagtatcttacctcacctattcccttattaacctctgataatgcagaagtgatgtcttttatcacactccatttcaccagacgcactatacttaattttccatcgttaggtttaatgaaaacccaatttcacaactcacttctctcaggaacctacaagtaatgctacgtttttatcaggcccaattaaaagacgttatgatgttcctgttcaagagggagccttaaaactaatgtgcgattctgctgctaattcaacaagggcactggaattcacacgctgctcataaaatgtaactcacaccagctggcccagggacagaggatttttcattttttctcctcaccagccccttaattctcatgccttcttctgatttatgggtttggtatgtttatttatcgtgcaataatattttggatttctttcacactttttatatagctgttacctaaccctgtgaattcccctgcagtaactcttgttactgcccgcgaggagcttgtgggatgggcagaaggattttggtgctgtgtatgagattttgggttactgtctcactgatttcctctttgctgtcttcctgctctctcctcctcttccttgggatcctagattcatcaccgctgctgcccacccttatcccctgccccactgctaccagccatatagatctccctctacctttagtcacatatttccatcacttactgggaattgccactccaactggttaagaaatatttaatgagtacctatactgtacaatgcacgttagatattgtgttcatacagcagggaggtatgttcagggagaaataagcaggccacagcccttgaaggaggggagaagaaaatataaggtgtgcgtgaataagcctaagataggaagagacaggcccctaagagatggaagaaggatgtgccatggggtttggcaatctggaaacattctccaagcattaggcattcatgatccacctctgtgtctcttgccatagttgtgtaccatctatgtgacagctgtccaatagaactttccacaacaatggaagtgttctacatctatgctctgcaatttggtggccactaatcacatgtggctactgagcgtctgaaatgtggctgatgagacagaggagctgaattttaaattttgtttaattttaattaattcaaatagaaatatttacaggtggcttatgtctactatattgggcagtgcagatatacagaaagagatagggaaagaaagagagttctagagtcacacagtggggcaaagaggtctagaatagcactggccagtggaaatatattgcaagccatgtatgtaatttaagatggtcttgtggcaacattaaataaggcgaaaaagaacacatgaaagtaatttcaataatacattttacctaaccccatatgtctgaaataatatttcaacatataatcacaaaaattattaatgctatatttttacattctttattcacacaaaagctttgaaatccaacgtgtattttacacttacagcacatttcaattcagactggccatatttccaggattcaacagacactggtaaatggtaggctaatgtatgggacaatgcaggtgcacacagacttatccagagccagatcaagttctaaagagaggtaatttagagctggagtaaatgctaaataaaaagacactgatccagtgtaaaacagctctcacccagcactatccaaaagaaccttacacattgacaccaatgttctatatttgcactgttcaatatggtagtcactggccatctgtggctattgagcactttgaaatgtgcctactggtgctgaggaaatgaatgtttaatttaattttgatttatttcaatttaaatagccacaggtggccagtggctactgtattgaacaatgcagatctacacaattacatcttcaaaacttttcttcagataaactctcaactattttttttaactttgcctcattatgaatgatagtgcaacataaaatcatgaatgtgatgtgctaattttgttttagtgctcactaaaatgtttacataactatttgagaagaagtcggggccaggtgcggtggttcatgcctgtaatcccagcaatttgggaggcctaggtgggcggattgtctaggtcaggagtttcgagatcagtctagccaacatggtgaaaccccatctctactaaaagtacaaaaaaattagccaggtgtggtgctgtgcacctgtaatcccagctacttgggaggctgaggcaggggaattacttgaaccagggaggtggaagttgcagtgagccaagatggtgccattgcactccagccaggggtgacagagcaagactccatcttagaaaaaaaaaaaaggggggtctgttcatgttgcatgaggggaactcaatctgcaccctgagaaatgttgagtctgggtcccagaatcagatagaatggggtttggatcattccttggccaagtgacaaatctttctgcatctcagtttctttatctataatacagagaaaacacatgttgtaaggattcaaagagatagtgcatgctgagtgctcagtacagtgtctggtatccaggaagcagtaaaaaccagtatttgttctgatgaatttgtgcataatgtcatattggacatatgagaatccacacactagagatggcatctagggagtcatttagggcttctttcgcctttccttgtctcctctctgctttcctttatgacacaccccaaagccatctattttactccattcctgctgctattgccctcattcaggtcttcatgacaggactactccatcagtttcctgatggcccttccttctttcacagttccctttacagagctttgatcaagtcatttttcttagcaaaagtcttcagggagtcaagacaaaatttcttaactagctaatcaaattcctgtagttccttaccagtatcaatgtatttcttctatcactattcatcctagctccatgtgctctttagggcaggagagtatgaagagtgatgtgtaagtagctagcgactgctcattgagaggagagagtctggaagaggagagaagttttgaggtgaagaggaggctgggtcacctgcacagagtggggatgcaactggaaccaacactgtggggactgtggcaacagcaggtatcagagtcaaagcacagactcactctgaagataaaacattggattcaaatgtgatcttcacagatttctagctataggacctcaaataagttacagctgacccttgaataacatggaggttaggggaaccaaccctctgtggagttgaaaatccatgtataacttatgacgccctcaaaacttaactactaatagcctactgttgagcagaagccttattgataacataaacagctgattaacacacatgttgtatgttatatgtgttatatattgtattcctacagtaaagtaagctagagaaaagaaaatgttattgagaaaatcataaggaagagaaaatatatttactatttattaagtggaagtggatcatcatacagttcttcatcctcattgtctacacattgagtagactgaggaggaggaggaggaggaggaggaagaagaaaggttggtcttgctgtctcaggagtgacagagtcagaagaaaattcatatattaagtagagctgtgcagttcaaacccatgttgttcaagggtaaccatactttgagcctaaggtctttatttgtaattgctgatggtgatgacaatgatcatgattgatcatcatcatcttcttctgagaaggttgttgcaagggttaaatgtgattccactggaagaaatctcaaggtggaacctggctggcagtcagtgcctcccctcttctccctcacaaaatactagaaaaggctcaagataataaacttgtaacagctctgaaatctaagtctatccactaacctattgccagaatctgggaagaaaacttgtttattattgcagcagcacacatcccatgtgcaggaagatatatatttcaactgctaaaaatttctcgaaaatccctctctcaattgattcaacataatctctcaattgattcaaccacaggtagtttcccctccaacgctggaagtgattacatttccttgttgaagcataagatgaagcagttggcttgtgcttaggagtcatgttgtaagaatgctctgttctgtgtttctgaattctagacttgcactagcataggtgtatgagatttgtgacccctgaggaacagtagattcacatcctcttactcaatgtaacaacagatggatttaccttttcccatctttcttatgtctgaccaaacacatagtagggttgaacttgtagaactaatagtaatagaatgccactccactgtgccattttctatggagctgaaacaaacatgatacaattgactttgatagactttgttacttgggataaagcaaacccaatggcctgaagaacagaaaagaaatgcttccaattttctcattttaattcctgagctcagagaatcaaagactgtatcaaccatatagcagggttggggcatttccaagctctttctcctcctaaacctccatcactggggtctttgacatggtaaagacaaaagatggtatctttgtttccgagacgcagattcagtgttaggaagcaattgtgatgggaacagtcatgggaaaatgcttctaggattcatttactgtttctgataaagagatcaatcctcctgcttgtgggggagagtatgaattccttctttcacagcactcacaccagatggaaggatggtgttagacactctatgtagggatgggggctataaacatccattgctcctcttgcttaaaccactgccagaatttgggaggaatattgatgaattatagcagcatcacacatgccaggatggtatggaataaaaggattccaacaataactagttggacagtgaggcaacgatgaggatctacctcctctatttactggcaagcaacaggtctggagagacttctcttcctttaaagttaaataaacagaaacaagataatatgaggtcttagaagaaaatccaccatgttaacagtaaggaaagtgatagcctggataccgtgaaaagtacaattttcaaacacacacacacacacacacacacacacacacacacacacacacacacaacagtcagtattgactgttgacccaagagccatcccctgtcttgttattttctggctaagttcaccgtatgacttggtgggggcgggggcagggaatgaccctactcccaaaacaagggacaaattctgatgtccctacgccatcaaggtgttccgataccttttgcaagttaaataaaaatcttttatatgatatgggagggaagttccattagaaggcttctaggaaaggttctcttatctctaagaaggacaatccagtggcccgtctctgccaccagacagtaccatgtctgtgtgtgatgcctggaactgctgaaacaatcttgcatccatgaggggagctgggctgaggttgccctcatgccaagataagaggatgaagaggagagcttgaaagaatgtgggtcctcaatgacattcatgggcatctcattcaaccaactctaacacttgacttcctgttctagaagataatacattaacttgctgcttaagccatttttattcattttttttctgttactggtatcttaatctaaacaacagaaagtagaagtgcattttaggttccttgaagtttattgaaaacgaaatgcgagaaaagatagaagaataaaggaaattaaaggtgaaataataagactaagacaacagacttttcccaaaatagatcaagttaagaagtagctagaaaaaatatttactgggtgaggtaagaaacaattgtaaagaaaccaaaatgcaataccagaattaaaatgggcactggaatctgtaatgagaataagcaacaggcttgtggagaattaatttgaaaaacttggaaattaaaacgcaaggaaagcagaacaatacaatgtatatttcctttgtatatatcatctgctcatgtgtgttcatgtgtgaagggaacaaaaagacatttttagagaaaagaaaacaaacatataaaagacataattgctgttacagaagaacagaataaatggaacagaagcacattatgtgtcctttcttatcaggacacaatattaaaacaactcattggcaaaataaaaacttaaatcttcacgtgtaaagagttctccacctacaacttaaaaatagagcctatattctgatacaattgtttaaatattattgatgtagaaatactcagataaacatctaggctggaaaatggctatgtataaaaaatcagaaactacgttactcatacattttcttgcccaaatttaaattccagaaaacaatgaaacaaaatttttcaagtaaaaatgatgtggctaaaaaattatacagtaaatagtttttcatttgcgaagctacagaaaggcattccctgacacataaagaataagaagttatgttggctctgattcttttccagagggttgggtagctgataaagctagtcaaggatgtgagtccagaaatagagaaaaaaacatccacaagaatggaagaagtcttgttataaaaaaagttgatttggtaaacacagatatgagtgtaaaaatcacaataaatgtgaatcaaaacagaatgaactataagaggtaatgcttaaagagaaatcagatttaaaaatctaatataaaaattcttggctaaaatttccaattgtattaacaaaaaccaggaagtgggtgactgatacatcactaggaataaaagtatattatcttcttcacctttcataatggatattcaatgtgtactatttcaatcctgacactcttaattgaagaacacaattttaagcgaatgtgtatgtactgtacagggtactgtagaggtgtgcatgtgtgcgtgtgtgtgtttaaggcatcaactactagcataacaagaagaatgaacaggattcaaatagagataaaaaaacaaaacaaaagaaaaccctgacttctagtacaagtgcatctggcatccaaattttgttacttgtttgatagaagcacctgccaacatagaaatcaacattaaaaaaactgtgtaataccactgaaaactacactgtcctgacaagcaaatgagaaatcatcctgtagaggtattttcataatccaaggcacattaattcccacagaacaaaactgcctccactaaagacgaactcatagtaaaaaataaattataaagaatgacaagagccttgtaaggaatcttatccccataggagagagtcagaagtcatcatacacagaaaaatacacctctcaagaattgaaaataataaaacaatcaaagagactattaagtaaatacatttagattgattaaagagaaaaaagaaggaatatgaaccattgcaataatgcacacatgacagaaaaaggataggtgggtttgaaaaatatacattcaacttcttgagataaaaaaacatagtcattgaaaatagaaagaaagtaaatatgtatataagaacagacatggaacataacacaagttaaagatacagcagaggagctgaaaaaaaacagcaaaagctggctctttcctttgaaaacaccaacaaattagacaaacctctgccaaaaaatgattaaggaaaaaagacacaaataagccacttcacagttgttagagactgacagaacatttttagcccaggcttagactggagaatgattaatgaccagagaagccctgagacacatctcaagactctgatggacgtggtcagggtcagctggtaaacaccagcccatcacctgggtgctagctttttaaaaaagaagtcatattttgagatcattacagattcacatgcaatcgtaagaaataacataaacgggtcttaaatacccttcacccagttttccccaatgttaacacttgtgtaactatagtacaatattataaccagaaaattgacatatatgttactgatcttattcagatttcattagttttacatgcgcttgtgtgtatgtttaatttatgcaattttatcccatgtgtagacctgtgtgaccaccatcacagtcaagatgcagaaatggttacatcacaaggacctctcatgcaatggaacactagcgctgagtttcttctttctacactaagacctggttactagattctgggagactgcagcaataatgaaaagaattgtctctcagtgaaatgccaaactccgctagggatcgacaaactgggatcccatctttcctgatgctcctttaatccaggcttccacaggaccacaatatgtggctggtcatacatgctgtgcactgttcaattttagagggtgtcattcctttgacggccttgctcttgtgatctacaagggccatcaatcttgacttgttccagtgactagcggttattattttcattttgagtaaatcaagtggaaagtttcacccatctggtctagagaggaagcaataagcaaagcatcagtctatggacttagttccctaagagctgaggcagagttaggaaaggagacctctgttcagagattcttctatgtgtctggagtgaactgggccacaataaagggttttgtgcatgtcatgtgtgtggggagtgtgtgtatcctggcaagcatgtgagttttcccttacctcttctccaaccagatataaatggctttttatctgttttagaaaataaacatctaggtataattttgttcaaaaaagggtttcactattttttaaaaaactttcaaaataatttttttctttttgtcaaaattctatcaaaatcagtgaggaaagaggcagcaaaaatgctgataccagtgttccacagcataggttgtataaacaatacatttggaaaaaaaatgaaaggtcgttgagtttgccagagcaacagatgtttagtagtgatagggattctctgtggctggccttaaccacttagtgatcaaactaggaagtgagggaataaagctgaggggcgtgcatggaatcctggaagtattttgttgcaccacaaagaagaagggatataattatggactttttaagtcttttaactcactggaaatataagccctttttggtaacatgtaggttgattatttaattcttgcatattcaccatccatttatactttcagagacacttgttgttgaaaataatggccttaaaaaatgctgaactttgaccggtagaagaataacccataaatagacattgaaatatacgcctaaagaattttataaactgatgataaagtagagtacaaatattggttggcaaagaatggattcccagagagtgtattatttttcagaagagaatgaagtatattaaagtagatgaaactgtaaggtggcttagtgttagaaagattaatattattggaaagttacttcatgctttcagtaagaagttctgcatgtgactatggcttgttaagataaatagcatatgcaaaagaacttagaagaacatgtcttggtcagtaagttactcaaagcataaataataaagaaaggtaaatcacacagttttaatattcttgcaagcatgaagggagtgataagggtgtggcatttgagaggagtttatatggaaggaaagactgggattaaatgaggaaggatctgagttatagataaagggattgattgaggcagcaagcacaagaaatggaaagcgactctgcatgtcagttctgtgtttcacagagccactaccagcataaataaaacccggtattgatagatccatgtggactcacctgcccctattctcaaaccatcacttaaaggaaaacttgggcaggtgaacttatcctcaaagtggggccctgtgttgacagggactgccagcaactcggacagtcttctgccttgaaaattctagagtgtttgaagaatctgatatattgaggaaaacggcaagtccaataggaaagactgagaggctcacacaatactctctgaagacagggtagtggtctaacacgtacagactttggacatgaatagggctgagtgagaaccctgacaccatcacctactgcctgtgtgattttgggcaagttactcaatctctctgaaccagtttctgcaaagcctttatggctagtatctctgaaaactggagatagaaagagaaaatcaagcactgatttataattgttagaagctcaacacatcagaggttataattgttagaagttcaacacatcagaggttaatacaacagaagaagagatagtcatttctctccatggccaggatcctcaaatctgctgcccctctctttccctatccatagtggctgaaacaacatccttacaactccttgaatcccctcttccttctccatgttcttttctccaaaataaggcatgagaactttttcaaaggccaaagctgagcatgtcacctccctgctcaaactttttattggatgcccactgtcctttggctatgttccagatttaagatatttaatatggcttcaaggctatgattggtctagctctcaccaatctcatttgcctcatcttgtgtctctctgtcctttcccctctaggctgcagccacactgtctcctcactgaattctcgcccacctgagaatctgtacaggacgtgctattctcctggagtgtttataacttttcccccaaacttccaaggccacgtggactcctattcatccttcagcactcagctcaagtcaattcctcctctagaataaacaaacccatctgtggtatgaatgaatggtggttaccaattgggttgagtaggggcaggggatggctgggaatgggcatgagggatcttcctggcaagtctgtatattactagggggctgggttgcaaagtgtatgcaattgttgaactcataaaatggaaaacctaagatttctgtgtttttttgcaagtaaattttatctcaaaggaaaaaaccagactcttgagtcggcattaatgatgtgtacagttaaatattgggaggaaagggaagtgtagtgatgtctaaaatttcctttgatatgcataaaaattaagatggattgaaggatggatagatgggaagataggtaataaaataaatatagtaaaatgttaatagtagaatctaggggatgactggtcactaaaagtattttaacttttctgaatgaagatatcaaggaagacatctctgtctgcctccatccccatctgagggtcccatgttatatcctaacagtatcattttcatgaattacaatatatgtatattcctgaacatacatcgtcttcatgaattactatagttattgaataatagtgagattagtatcttatccttcaccggactgtaagctccatgaagacaggtatcatatctgtgttgtttactcgtgtatctccagaatctagtgcctactctggaaacactcatttgttaggtacaccttgctctctgaaatccaccctccaccttgttgataaatacaatgtttgtttatcttcaaggttcatctgtcatgtcttctaattcttttggtgaggatatcatgatctctatttcctgcctcagttccatttgccttggtgagtgtggggaggttgataagccacatttactcaaaatgcatatcttctcctgatgggcttctggtgattttaactacactcagatccgaagctcttctctcagagtgaaaatgttcagcttcactgtggctccaggggactggacatgatttggagtttctcattggctccagggttgtatgtgcactgaaaacaactggcccagaattttgtattatgtatatatcaccaaactccataacctgcacacttatgggaagatgtgtgatagaaggaaaagactaagtaatgcctcacactgaaaatacagactgctcctattttctatctctcattcataaaaattataataagactaaggaatgcaaaatagttgcagagtaatacttagctaaactagaaaaactcaattttgacaggtttttacaatcttcagcctgacaggtgactttgtcttttgttgatgtgcaagaaagagaaaatgaaataactaaacttgtctgaaagatgaaatttaaatgtgcaacagatgtttgaaagagtttgccattgttgtgggtggataaaagcttcctttctccatttcaaactatgccctggatatttaggctgagtttgtggatattatgaactacaaagacaacgggacattaagacaatggaaagaacacagtttgggagttacaagacctgagttttcatcctggtgttaccactaaattatcttgcacaattaccttcacctttgtggaccttaattttaaaaccaggcagctgaattagaccaatgcttctcaaggtgtaatgtacatatctagagatcttctataggcagattctaatacagtgggctgaagtgtggcctgagagcctgcatttgtaacaagctctcaggtgatgctgatgatgctggtccatggaccacaccttgagtagtgagggattaggtggtctctaagggagcttccagttaaaagatacaatgtgttctttaaaggtcctggaatttctcttaaaaaagcaaacattattctttctgctcttactgaatgaatgaagtagtacagcttagtattgttcaaaaccaaccaaaaaatgcaactaattaaatctgatggccttaaccctggaaagaacagatacctaacactctcataagaatgaataaagcagtgtgtccccatcaaggttcagcctggctgatcctcaggtgctgaattatagaggctgatcactgaaatgccaaactactttgttttatatagtagattccaaatgctagtaccgtacaagagtcattcaaagaacatactaaatatagattcctttgctccatattctagacataaggatttagtggctttagtttggggccagtcatgttttgggaactactgttataaccattttatgggggggcaggatagcacctagggaagaagaatggtaagtttgacccaattccttattgggaacatggtaaagatctttctgtctgtctgtctccctccttctcttctcccttccctcccctccccttcccttcctctctctcttttttctttctttcctttctctctctctttctctctccttccttctttccttccttcttttcttttctttctttcatggagtctagctctttcgcccaggctagagtgcagtggcatgatcttggctcagtgcaacctctgccacctgggttcaagcgactctcctgcctcagcctcccaagtagctgggataacaggcacctgccaccacacccggctaatttttgtatttttagtagagataagatttcactgtgttggccaggctgttctcgaactcctgaccttgtgatccacccacctcggcctcccaaagtgctgggattacaagcgagagccaccgtgcccagccagaagatctgtttttcaagcctgcttgccagcctctgaagaatcctagtgattctcatagtaataaaggtgtgcaagtcataagggagtcaatgttacagggaaacagtccctgaatagttgcccttatgggatgtcaaagctttgaggatccctggcagctgcaatgagaggtctggactgtaattcctatcttcttgtctattgaaatgcatcagaagaaccagggttaaatcctggctctactacttattagtcaaaggctttgggcaaattaattaacatctcacatgttaagccatgtattagttatccactgctacttgacaaactacccccaaccacagcagcttaaaataacaaacatatacgatctcagtttctgcagatagaaatctggttgcagcctagatgtgtatctctggctcaaggtcttttgtgaggttgcactcaagctgaccgctgtggtaatgatctcatctgaagactcagctgggagagaattcaagttaactgatttcataatcactgacatgatactgacagattcattttttcatgggctactgcagtatgggactcagttccttgctggctgttggctgggcatctccctcgatttcttgccaataggtcaacttacaatatagtagctagcttcccaaggaacagacaagtgggagtgagagagagcacccaagataaaagccacagtcttcttaaagacaaatcttgaaagggacatctcatcactttatcatatcctattcattggaagccagtcactagatcttggctgcaatgaggaagggcgttatataagaatgtggcataggaggcagggatcattggggccatcttaaagtttgccaaccacaaatcctaatatcattctgcaatgtttttgtgagaaccaaaagaggtaatgtcgatgaaagaacatttaaatatacacatatgagagtatattataataattcattccaaggagtccagtcaaaatcttccagctgactttgcttagctttgccaagtattccaaggcattcacttaataaaagttttttaattcatgaaagcttctaaagtaccctctttacacttttccaaagagttttccaagatctgatttttcaaggaaagtaaatggtttaattttccttatcacatgaattgccattgacaacaatctttaatcgttaaagagttaacaatgtactttcaattgctttacgcagataaaaaatccattccctaagacaatgaattagccacataattgacagccaattccagtaataaaacgctaattaagtgataatgctaagtaaaaaatataatgtgatgaatttgctaaacaatggcctaactaataaattttcatgctaaataaatgatttggaatggtgactaaaccctcaccacatttagggtcagttgaaaaagcaatgatgctttcagaaaacaatgacagaagtgactgtgccagctaacatccttaacagtattacactgggctctttgccaagcagggccaagggactaagtctgaatggggtaggtgtaccggaatctggggggctggagcaatcaccatgatgatagtatgggtgactagcctaaagaaaggcatggaatagccaagtatagccagctgtagtaatagcagaacccagcaatgggcaagaagatgcagaaatcaatgctagatcatcttgagctaaagaagatcagggtcagcaccaaggacagatcctggatgcggtggctccgggaagattcctgcagatagacgtgttttgtcataaacaaggaagtcaaagattacagagttttctccttaccccagaaggctaggctagtggtgagactcagctctcataggcacaagggtcttcactattttttggaagcaccatggtttcaacccatttaatttacaatggtaccttctgaaaggatctaaatttagaggagaagtccatatttcttatgggttccactggttttgactgacctttacagctggaacagggttctagcttccacatatcaggcacatgcttgccttgggagcctctaatagagacactctttcctgacatggctcacatctgttacctttttaaagtctttagtcagatgtcatcttctataaaactgcaatcctcctccacttatgactcctgatcccattcagcatgttctattgtttcagtgcaccctcacttgttattatgtcatatcatataatgtacttatcttttgctgtccattgcttatttcctgtctctctttccacttcctaccatcaatggaatgtaagctctagaaagacagggaatttttaatttctgtattcttcactgatgtatattaaaagtgcataatatgtcaggcacatagtaggtgctcaacaaaccttgttgaataaatgagtggcagcatgttcagaagcttgttacactctaacctctgaagagagtagtgcaatcttagaaatcagtggagtaaacaagagcctatatcctctgattttaagacaccactgtcccagtatgccatcctcttacttagtggcttcagaggtgtccgcatatttctcactattcgggagggagtacattatagtagtaggatcatatgcaagagaaagattaagtttaaatcctagctctactactaatagctatgtgaccttgagcaagttatttaatctccctgaacctcaatctccacatgtgtgaaagaagcctagtaccaacaataatcatcaactcataggttttaaggattaaatgatataacgtatgcacagcatctagcatagtccttggcacacagttagggctcaataaatattagtttcttgtactttcccatttaaatacaatatgatacatcccttaatacataagagtaaattgacttttcagattatgccagatattgggaaggctcacaagggcatgaaattggagaagagtaagctgtgactggggaagtgtaaaaggctagaagcctagagccctctggaggagagaggggagatcacaagggtaggggcagtaggggacacaaagtgggtctgaagagtgttccctctgttttccagggctacactgagtggtagagagtccaaggaagccagtatttggtgatggggcctttagaactgatgactaggacaaagatacaaggattaggactttctaagaaatggaggtgcaaagtgcaccatatatctctcccagactagtgcaatggtcccctcccttgtcctcctccctcaaccttcctctatgggattaaaatctaagagtaaccctagtcatcgctatgtctgcaggtcctcattgtcccagcaatgcataagatcagttgactgaatactgaatagtgaaagtgaaccattgtgatctatcctgacttaaaattagcataatgattcattcaacaaataccactcaatcgtattcataggccaagcaccatactagtctccagggatatagtagaagcccggacagaagttgtctatgcaatcatggtttaaaagtctggtgaagatgacagacattagccaaaaaattattaaatgaataaacatttgcatacaagaaatttctgacacatgctaagagggactagaatgtagtaaaattaaaaaaaaacaacaagtggccactgtttagatagacaatttagggaatccctcaaaagaagacatttaatcatagacctgaaggataaaaagtggctaaacagtgaaatatagagtggaagactgttctggaaagagcaaacagaattgtgaaagccatattttgggaaatgcttagtgttttcaaagaataggaaggaggtcaatatgactggagtatattgagcaagacagagagtagccagagatgagactaaagatgctgacagaagtcatgtcattctgagccttgtaggccacgaggttaatttttacttcatctggagggcaatgggaagccaataacggatttttggttgagcagtggcattgtgagtttgttttttaaaattgaagaacacgctaggcaaatggctatttcataaataaagcataacaaagatagtgagttattggtatacttctgctgatggatcaatatgaaaggagaatgatgggatagaataagaagggttacagagagggtgacagggaccagatttgcaagtgtgtgtatttgctagaacacagctggctgaagattcactggatgaccatttgggtctccactgcagaagagacagaagtgactgttagtttggaatgactcctatgttctgagcctctgtcatgtctgtacatcagtgggaatttcatctaacctagatcaaagatcctgaagataaaaggtttcaccttggaaaaactcaactggtcccatgagacattaactgaataagaacactcatttcaaagtcaaacatgtccaaaaatttccaggtatcacaccctcaaaatactgactaatcaatacaatatggagcaagcagggagatctagtcaatacactcggcttaaaaatggtttcaagaatggaatgccgtagaacaccttctctctaccattgcttcattacagagagttggccatacccgttgggttgtagtgactgttaatcctacaagcaggggtgtgtgtgtgtgtgtgtgtgtgtgtgtgtgtgtgtgtaatcagatttccatgtgcaccagcattttgtgctgtcactttccttgaagtctgatataggcagaaacaatacttacttaaagctttatccactcccactctccaaaacttttacctcactatcaccaagatgatctttctaaaaccgactcaatccttcctttctacttcttaaaatctatgttagctccttgcagaaacataatacatttcaaactccctagtattcgagaccccagttcctgcttacctcttcaggttcatcttttaccacttaatcctatggttctaatatttcaagtactacagagaagccaatccacttataattttaagtgcaacataaggaagggtcttcctgggaacctaacagcaaggaagaccaacaccatggacagagacgctaacaccgtcccctgcccttcaccctgtctttcaggatataggaagaagttaacattactgatgtcttttggactctggatgttagggaatacatttatactcacaaggaattgtacaagagagcaaaagctatagatttgtaaaatgtgcagagaccacaaaactacttgcttgtaatagcagaattatcacgctaatccaagtggaaaatggaggttttgaaaatattcctattattgactatattagccaagtagactttcccacctctatgcccctgtatatgtattcttttattttagaataatgtcatagcttgttaccaggatgaccacaattgattccttctcttcctatatgcatatgccatttttcctatagaagggttgagtctgctcctctactcccttaaatttaggctaatatgtgactgcttttaataatgatacacagcagaagtgaagctggctagttctgagcctagtttttaggaggactagcatttctcctggctttctcaaacacttgctctgggggaagacagctatcatgcaagaagtacaattaccatgagtctgtcctgttgctaggaagcctaaggtagatgtatagggagagagtgattccagcctaccctagatgttacagtcattttagcataggggttgaatatgcaaatgagggaggcatttgggccttccatccctgacagatgccacctaaggaagaactgaggtcccagacatgttgtcctacaagagctgtcacagtcatctccagccattcaagtcatcccagctgaggctccccattttcaagcagacacaagctatccctgttgtaacctatccaaactcctggcccaaagaattagaagccaaatacaatggttgttgttttacactgttaagttgtgatatggtgtgttacaccatgtcacttatttcttcttttctgcattgactaattctgaccacacagtgtttaagattcaacttctctatgatgttttctttgatcaccttgaagtaccttaaggattctatttcctgctggtatttctttcctttcctttcctttgctttccctccctcccttccttcttccctcccctccccactccttcctttcttccctccttcctccccccttcctcctcctcctcctccttcttcttcttcttcctcttcctcttcttcttcttcttcttattcttcttcttcttcttcttcttcttcttcttcctcttcttcttcttcttcttctcctccttcttctccttctctctctctctctcgatagagtttcactctgttgcccaggttggagtgcagtggcatgatctcggttcactgtaacctccacctcctgggttcaagtgattctcctgcctcagcctcctgagtaggtgggattacaggcatgcaccaccacacccggctaatttttttttttttgtatttttaccagagatggggtttcgccatgttagctagagtggtctcgaacttctgacctcaggtgatccacccaccttggcctcccaaaatgttgggattacaggcatgagtcactgcacccagctcattcctgctggtattaaactcatcctggctgcttctcacctagaagaatttgatatcctatcaactcatcgtggcttcctctcacctagaaaaccagcatggtccaaatatcttcctttttacctcacagtttttacttcggagtttcaataactagagaaacatcttggctgccaggacaagtggtgtggaaaagccaggtatccatgaccacatagattaaacccatgtaacaggtgcccatcatctcccagaacctcctcagaatactgttgtccccatggctacctgtagggtcatccatccaatcaagaatcacatctgttgttatatatgcttctttcctttactatttttcttggttcttccatcgggagggccatatagtagcctatctgaatctctgcctatatttgtatgtggtctgaagatcaccagctgatttctcttcctattcctatgattgaaggactaattgtatcagattcccagatccaaatggttgacttcttgaggatattttgagcagcagcttctggttttgtaggaaccataaaaagggctttgtaaaattcccttcagtgttggctacagtgggtgatggcaggagtgggagagaggctaagatccagatagcatctgactggcaaagcatcatcccttgatttctttatccacctttattcaattctgaacgctgaaaacaggacaatagtgtgtgatgtcagttgtactgagctttctaaatattccttttagttttctctgagtatataggatttatatacctaagtcttgtctgtttatccaactattcatctacccatctgtcaacaagagtttcaggtattcattctgtgccacatgctgtgccacatgttgaggatacagtaataagcagaaaataaatggtccttccctctcgagcttgccatctaacagaggggtcaggcactctgctgaggatacagtagtaaacaaaaacatggtcctcctttcttcagcttcccatctagtagaggggtcaagtcttaaacacatttgcaaaccgcagttgttgctgagaaaaaaggtggaatacaattctgtcatagcacctaacaaaagaaatccaatctggtgaagggagaagggggtcaggaaaggaagaaatgtaagaatggaggtctaaaggaatcaattaggagaaaagcatgggtatagccagtgatctagatgaggagttggaaaacatttctgtcaaagaccagagagtaaatattttaggctttgtgggctaggtggtctctgtggcaactactcaactctaccattgtagtacaaaagcaaccataggaaatgcatgaacaaataagcatggttgtgttctaataaagctttattctaataaagacagagtgcactggatttggcctatgggcctcccatcccacgctccttctaccacattccttctaccacacttccaccccacattccttctaccacaggacctttgaccatgccattgctctgtctagcaatagcacagtcaaaggtcctgtggtagaaggagtgtgacaaagtttaagtactgtgagaagattatggtgtcacggagctcacagagaaaggggaagtgagatgagagagcctggggaaggtcagaaggacaagacctgtatgtgaagtcaggatggggactttgatctttagcttataaacaatcagaagcaaaagaattgttttaacccagggatgagtggtacaacgtgtttagatttgccttgaaaaggtctccctggctcctatgaaaaaatagactacagaatgacacggatggatatgaggattatttaggagttgtggatcttattcaggtaagagatgatgatgacttggacaaggatggaggtagtggatatagaggaaaatagatggattctagatatatcgaagatgtagactcatcaaaacttggtgttgaactcgatgtgggaggtgagagagaggaacgtgtcaagattaatctatgttacatctctcctgaatgtatccttgctattaaggggaattgaagttttatttcattttcagccccatataattaggatatcaactcatatgattggtaaggtgaaaagtaaatcatctgaacagagatgaatcacaggttaatggatcacgacagctcccccaccctcactggacaacattctcttggcagcttctacacacacctctactgggcataccaagtcatataactattatctgtgttccctatttcatgggctttttgagagtagaaatgccatttcttatgctactaatggttattattttggttagtggaatcttgtgctcacttaacatctgtctattctacaggtgagtgtagatttgagatgtgtttgatgtctggtggggtgggcagttctttccacctagttaagagcatctcactaaaagtcaaccggtgctgagtaactaaacatcatggaacccttttcaaaattatgtaggaagcaacccagagaattatggaaatggtgatgcactgagcataggggctttgcccatccttggccctttgctatttccttctactacctcacatgcagcttttcaatctttgtgatagtccgccctatggctcttccattgactttcctagatccactcccaaccattaatacataaaccagacctcaggttcttgccgtaaacttctactttgaatgtagagatcctatcacaatccagctgagtagatattgatggggtcttctaatccatcagctccttcacacattctgagttccatcccaggatccaggtgatttccagaatgctctgcacttggaccacatttacacagccccatttatagcccactgttttgatgttataccctgagctttaactgatggcttttctataggtcctcctatatgtaagtcttggctcaaagttctggttcttccattaacttgctgagtgatcctaggcaatgagtttcacctctgtgggccgcagtttccctattcatggcaaagtctccaatcacattgtatacaaaatgcagtgaacatttatatccccaggccaggctcctctgttgagctccaggccccagagtccactgccaacctggcatctcttccatgactcaataacacctcaaatcgattggcctagatgtaaatgtccccctcttctgcttcaaatctggccccttcctgtgctatctcatttggcatcatcaccacctacctagagtgagtatgagcagaaaggaagagcttcagggctaaggccggggacacttcaatgattagaggttgggagcaagtacagaaccagtaaagaagaatgagaagaaatggctggggaggaaggcaaaacacaaggagagcaaaagtcaagcaaagaaaatgtttccagaaggaggggctgcgtgataggtccatcatgtgaaactaggttcaagccctgggcttggtttctcggtagctatgtgaccttgagcaagttacttaagttctctgagcctcagtttccataacatgcctcatagcattgttgagaatattaaatgaaatgaggcatagaaagtgctttgtccagcaattactcacaaaatgttagctagtagaattattatctatgttttcaactcatcaagtctgtagctttgagcagagggggggaaattggtctctaagctcagtttattctgctacctagcaactatatatttacatcgtcaacatcacttctttatccctgattactttaacaagcactttttaagtgctctgttataattcaagaccacctgtgaggtgtagagaacaattctattttcttctcaagatgtagtggcctaggataaattgtcaaaaagcaacttcagccttgtaactttactgaggtctctttgaaagtgtattgaggaatgcttgggccagctgacaatgacagtgaaggtctgtaactgataaaatgcactctgcttatctacaatagaaagctggatctatacaactcaaagagcatatgaagctgggttccaaaatcacacaaggacagctgacactgggatcactccaattcccaagcaggttacccttcctggaaagtgaatttaaatgggacacaaatgtgaagtcctttccaaggaggctccagctaccattccagcttcgtctctggccatacattcttgacacagagtatcttggacttcaaacccacttctctgagtccaccagacctcacacctcatatttccaagcttttgccccttccacctgggtcaatctgttctcttgcactattttcaaatcaaaatccatctccttacatcgtattttccaaatcacttagccagaattaatcacttgctgggtgtctgatcagtgtttctgggacactatacacaccttttctctatcatttatcacatttattgaaactaatccacttacaactctcctcttagaggacagtaatatcattggaggcagagaccatgtcttatttatctttacaatccctaaaatgcttggcatagagtcggcattcattgaatatttaaaggaacacctcagctactcccataaccaggagatgaaaagtataattcaatttgagaaggttctatttatgcagaaatcagattaggagtctacagaaaatattacatagaagacaaaccattgttgactgtacttcattcctttgaagggtaccgtgggacaaaactagaacggtcgtgtccctaattaaaggccacgggcccaattctagctggttctacttgtgactcattgagtgatcttgggaaaactctctgcaactcaaatgttcatttttaagatgagaagtttggatcaataacatctaaggtaatttttagttttagtttgattatgtataactattatatcttttttgagtctaatattcttctctaaaacttgtcttaatttaactccttagtgtttgtgatggaaaattggtcaactttctcaaggctgcctaaatttccattttgtaactgctaaggaataaacaattccattcaactttgggttgccaggaacttaataagtgtgtcctttaatctgtcagctaagtggatgattgcaaaatattcaataattcctgtaagatattcaataaaactggagggggcaagcttgtaacattcaattcttctcccagattcaatttaatcttggagcaacctgaaaatataattgttcctgcaaacaggatttttgcatctttgagttctttttcacaatgctctgttgagctctcgatttcagtgtgtgactcatcattgcttttccttgtaaatttccactccttccatcctgactcttagattgttcactgttcagacaaaaggagacaaaatcaaagatacggttgagattcccagattcggggaccctcataactattaatgggctttagcacccttcaggtccagtactcctatggcaataacctcttagttcatctacccagggaggtgagctagagccttcctctcccagagaggccataattctactatcatgaaagacagctttgcaaataaagaagaagggcttgagtctgacagtcctgggcattactttgagctagtgattctctgaatcacctggaaggcttgttaaaaactgattgcttggccctaaccctagagttttgggttcagtaggtctgaggtagggcctgagaatttgcttgtaacaagttcccaggagatgctgatgctgctgttctggagatcatgcttcaagaaccactgctttgagcagatgactcagtgtctgtggccttaagtttccttgtctatgaaatgggaataataacatctacagaaggcagcatggaggagtagtcttggactaagggcctcggggtgtcaggctgacctaggtttgagttccagctctgccatttaaagctacaaagccttaggcaaattccttactattttaaagcctgtttcctcacctttaaattatcaggtataatcataacacttacttaattttcccaccataccaatgagataagaatgcttatacaatataaaacactcagcacgtaaatgggcatataattaatgctctgtatataataactaggatcataaatattaacaatgtagtaattcctacatttcaaggccccagactaggaggattaagtgattggctgacacaaccagaaataaaaaaaaaaaaaatagccctgtaggcttggcaagcagggtcaaacctaacaagaaacagaacagacaaaatgtaaaatctttgatttgggccccaaaagtcatcttcatctgggctgactgaggcagccctagctggaagccatgatttctacattaggcagtcacgtgatgaatatttagaggttaattaaaacatgagtgatatattttaaacccaggtttaggatcagagtgagggtgatggtagctctctgaactcccagtgactcagcccaatgtagagggtcatggttgtcttggaaaccacacattccgtgggcatggaccaaatggagacagaagggtcaaaagagattttgagcagactgaaaaacagaaatttattccgaggagggctgatggctgatgcagtgactgtttagcctgagggaaggacctgggcacagaggtagctgcagtcaaatagctggggagggtgtgggtgctgcaggaagagaagcactgattccattaccctgtgtgacaccagagggcagacaaaggccagcacgtggttgctgactaatacatggttgtgtacaaaagcaggaatgaatgaagttacagaggacagattttggcttaattgaagagagaatacattatgagaaaagatggaaccaggtctgggcttggaactagatctgagtgtgaattccagctccatcattcattcattcatatattcaaacaagtactcaatgagtatctgatgggccagagagttgggcaactgtcattatgtactgatcaacaacaatgaggggtgggggatttaggatgcagtgtttaatacagctcttagcttggggtcatcaattatgccatttatgaaatcaagataatgattcctaactggttgcattgttttgaggatcagagacaatatgtgaacagcacctagcaaaatgactgacccagagagagtcccaagcaaatgtagcaatccttgacatcacacaccatcaagtcaagagtttttgccagagaagatcagggtcaggccagttttcccagagacccatttcccagccagctggccattttcctgaaagggttaaggaatctttacaaagagtttaccaccaccccagccagcctctattgttttaaaagccatgatccgtcttccctatttgaattgctttagttatataacatgttcctaaaataatctggctaaaattttgcctggtacttccttctgcctgcctcatctctactgaaccatcccaagggagtaccaagcctgaacattctctgaactgcccacaaagaaacccttttatgaggtctgtgtggtaaagaacaggaagaatatcaggtttcagggtccaccctcctctttggcagaaaatacctcttaaggtgactgtgtgctggctgcctggtatattttggtcatgttgggaggtacaaagtcagggaaagggtcctgtggctcttcgtgtaggcttccattgcacaaagtcctgtaacaaaggttctctttcttgaaccatttgtctccactgccaggctgcaagctctctgttaggcaggggccattctttgctcctctctctctataactacccagggattggtctagctttgggatgcgtaaggatgggactactggtctgcagtcccactttcctaagagggtcctagtaggatgattccggcagaacctgtctgtgcgtacatccacttggcagctgccttcctgaggcaggagtttcagggaatagaggaaccagtaagaagcactgttctcccagccagaaagtctatttcaccttgatttcctgtctctccttcactcgccttcatggtagagagaccgctaaaggtcaaaggaaagacaaagttgcttggttttgaaagtagaatatctgctctggggtccagggcccattatctatttgtcatatgacttcaagaagatcttttaatatctgagagcatcagtttcctcaactgcaaaatgaattcgataataatcatatggactatacagggttactgagagaatgactaagactccatatttgagcatgcttatcatagtacctggcaccttgtgggaatctgctaggctccatgccagtacctggccccaggcctctgttcagaaaacagctgtggcagcagcttctgcccacatggtagaaaagccagctgacctatcagtaaggaagtgaagttctccctttctcccggctgtcagtgaccttcctctgtgagactggtgaatgttgggctaccatccacagtagaggagaaggaacactgatttaggagtcagagagccttatttgcttctaattctatccctactctttcttcattgtgtgactttgggcttatttacttcagttctctgaagctcaattttctcattcacaaaataggaataatatctaatgatagggttccttgggagcttcagagtggaatttatataaagcataagttttagcacatagtaggtgcccaataaaagttatcttcttctttgggcattttctactagaaatcccagagccaaagtggaatttaaaattatcagagcgcatattttagattacattttaatgtaatatagttatatttcaatatatcctggtcctgaccttcacattttcctgatactgattatttttctcactattttttaaattgtaggttcttttattggatatatccccaaattctttgcagaatgagatggatagactctaactgaaatcaggagagatgtattctcattacgactctgcaatatatgtatgatttgggccatgaaagctctctgaacctcagtttcctcatctgtagaatgggaataattaaaaacctactagctaccttattcctacaggaataaggaactattgctgcagtggagcgttttgcagaaagacttcgtaaactatgaaaggcttacaagtagaaccatgtattatttgtgatataatacctcattttattcatctttgaaactacctctctccccagaccgtgccacatggcttacagcacaggggtaggcatgtactgagaaaaagtccattaaatcccagctccaaggtgacacttagcagagagctagatggcccagtgtctgtctgatgacccttagagaaggactgcctttaccttccagacatggaataattcaatagagggaaagcataaaaatcaggacggagttaactcatggtacccagtaggcaagttaatctgtcaaatgccattatgggaagagcagactaccaagtccccatatcacaggaattcaaaaggaatttattttgaagcatttttgtttggactgaaaatgaacaagaagatgacatgtgaacaaaagagataaagaagaagatttaagcaccagaagaaagacccagaaaatgatcccagtgagcaaaagatcgcagagaaaaataacaagtacacagggcagtaagatcaaaatcagattacttaataaaagctagcatttctctaaatggaaaacaatgcacgttgtttgtccttgaaatgtgacacgtactcctttttcaagaataccaaggcactccaaagcaatggcccatatctgacaaagccccatcaccctagagccctggaggtcattgttcctatacaatattagaaggtttgattgaatagatgtcacagaacttagcagtcacttgaaatagaaaaatcaaacaccgcatgttctcactcataggtggaaattgaatagtgagaacacatggacacaggaagggaaacatcacacaccggggcctgttgtggggtgggggatgggggagggatagcatttggagatacacctaatgttaaatgacgagttactgggtgcagcacaccaacatggtacatgtatacatatgtaactaacctgcacgttgtgcacatgtaccctaaaacttaaagcataataaaaaaaagaaaaaagaaaaccccagaaaataaacctatgcagggacaggtagaatttgaattaggctagggcctacctggtcaataatgaaataattgctcaaggcacgttcttctgtaatcttttgcaatgtaacaactattctgtgccctacctctcaatgctgcctcaacatttgtacataatctcagggcctcctaaagacaccgattcagaggccagacagtcacttccctaatgccacaaaaatagattcaattctacatacatcagggtgatttcagaagcaatttctcatctccagtgtaagcattacttacatttttccccctcaaatctcatcccagtggttccacagggcattttaaaggtacctgatgcattctagggcagtcaaaagatcctgagagtgtttttgtagctgtagcctgaggacgtcagatgcatagagagtcctaacgtattcagtgattcagactaatgcagaattttctaataattgagtataataagtcaatcattatttaaatattttagaaagcaatattgttatgatgaatgcatatatacagtcatatatgtatatttgtgtatatatgactgtgtaggtttatacctctctctgtatatttacgtgtctgtgtaaatataaaacacatatgcacacacatacatacacaccttaatcatttgaaaagtttgtccctggcctttaaaacatctaattagatttcactggatatttctcctcttcctttatggcaagttaaactatttcagtcttgggtgttttcatcttaagggtctaagttttggcccatagcgaacagtgacaatgttatcctttgaaacataagaaatcagtattacccaggtttgcatttgagatcagaaagattgagaaccaatatctaaaatttcagggtcacaatgattgtcaagaagttttggccataatcattttgcttttaagagtcctcccagggtacttttacaaatggaaaaaagtgcacaagaggctggactggacagaaaaggatgaattggtattacttgaccagtattttcaatcagatgaacttgcaaatgaacttctctgccccagagccgaaagcaggggatccagtgacaacttagcatagccagagactcagtgagctcctgatgagcctttctctttttttctattattattaattgacactaattatatacatatttatggggtatagtgtgatacatgtatataatgtataataatcagggtaattaatatattaatcacctctaaatttatcattcctttgtgttagaaacattcaaaatccactgctttagctatttgaaaatatacaataaactgttattaattatagtcaccctacagtacaatagaacattagaacttattcctcctagctacctgtaattttgcaacagaggttggtttacagatgcaaaattatagctaggatgttcctttcttttaaggaaaaatcaagcccattttcttgtcaaccctggtctatgtcaacaaccaatttccctgcttctaggaaatgtatgagtctcagtgatttatctggattgaaaatgggaaaaaaaggactggcttcatggttaggcaaaccgcaaatttgctctgatccctaagaaaaacagatgttaaatatttgctcataatcagtatgtgccattagactttgtctttaaaagccattatctaaccttaagaagaactcaaacttaccatcactggtaatgtgcaaagcggtatgatatgtccattaataggatgtaaagggaagtacgtcatatcagctatgtcatatttttgccaaaatgtgtaacctgaatgttatcatgatgaaaaaaattagacaaatctggattgtggaacactctgcaggacgacagccctagactttaaaaaaatgtcaaggctgggtgtggtggctcacgcctgtaatcccagcactttgggaggccgaggcgggcggattacgaggtcaggagatcgagaccatcctggcaaacacggtgaaaccccgtctcgactaaaaatacaaaaaattagccacgcgtggtggtgggcacctgtattcccagctacttgggaggctgaggcaggagaatggggtgaacccaggaggcggagcttgcagtgagcagagatcgcaccactgcactccctcctgggtgatagagtgagactccatcaaaaaaaaaaaaaaaaaaaaaaaaagtcagtatcctgaaagaaaaaataaagttgagagggctgttctagatcaaagaggataaagacagctgaaaaccaaatacaatgtgagcgctctgattggatcctggattaaaataacaaacaaataagcaatagagaacatttggaggacattgaggcaatttgactatgaactggtatattagatcactgaagtaaggttatactttattgtggttatgttgaagaggtatcctagttcttaggaaatacatgctgaattctctggaggtaaagtgtcatgatgtctgcaacttacttctaaatgattcagaaaattttgaaaaaaaaaacatggataaggggagaaagagagagagggtgagtacagccaagtgcaaaagtgcaaatgttgcaaaatggtagcagttggtgaatctaggtaaagggtatatgagtattcattttgctgtcttctcaacatttttgtaggtttaaactaatctctcttcccaaagacagtacatcagtatctaagcatagctattgcctctgtccaagtgctgtattctaaatctgggtgcctatgagaactctctgaatgacttacaaaatccatatccctcagttgggccccacctctcatcccccaggagattttgattcaggagataaggtgtggggtccagatatggatgtgttgaaaacctccccaggtaggttctgtgctacactggagcttaggaatcatgggcctgagttactctcagatctggatccattaaaaacaagctgtgtggctctgagatggctggccaaacacacttagcattgcatagcttacctataaaatgggaacaataatactaaggatcttacaggactatggtgaggatgagagacagtgtctacattatagaaggggataaattttttctttctttctttatcctctcatagatccccatcatcccaaactgatcatctcttgagtgattttttacaaaatggaggttcttccatttgtagcttacatggtatgtggaggacatctgtgttatgcacagattctttgagacttcttgcattacccaatttggggaagaggctgggaaatctagtctgttaactgtctgatagaatggctgtaagaacagaagcaagtctgtccacaaggaagccttagatgttggcagtcttggagttcttcttaggataagggttaaccctgatatcttaaccacccaaatcttgggatcctttattaacactgcacaaggactcaggtgcccttgaccaatgctacttggaacactggctgtggtggaactggcaaatgtttgagggatgaggcttccaatctaaatatgtaactcatcagccattgtattttagataagttgcttctctgagcctcagtttcctaaccactcagagtggagacagtcataatctgtgactcacctaccttatgtggtgtatatgaaacacagatttgaaaatcttaagccactcaattcagtgtggcatatttttctccttaaggacataaccatcctcctcctctttcttttttactgctattatttttaacctgtctctatttatgtccacaagcagttaggatgacttgctcccatttccatctgatttggggaagattttttaaatattccttttcatcttaggatgaactgccccaagtctttgtcagggagaaccttcatcccagtccatatcaggcaagcatccataccctatgcctggcagcacctgatcaatgtgtggggttcacagcagaagtactagggctgagctggaccacggatgtccccttcccctttgttggctctacttactgaatccgttgacgtcctgagaactagaagagaagccttcatcattgcggctggcgctgagcttggtggtgggtttgtcggcagaggccacaggccccatctccctctgggctccactctgggtctccttctgcttcttggccagcttcctttgggacatgtgcaaggggaaaaaaccacagtcagatggtgccagttgcattaaagcattgggtagattgttcttccccaatgctcatcctcaacccccaaatctggttcattctccagaaaaagaatcaaggcagaacaaaccatgaatggtttccatttactcagaaatatgagactcacgctgctgcctcacccccgacaatgcatgtgttctatgtttgagcctaaaatgggaaatcaatgagacttgtacaatgcttcccccactctcctttcagaggaaatcaacaagatttgtattcctttccctaagtctcctttcagagggaggaagtggctagactggcctttctgtttctgtggctctgaatgagattaaaaatggaggcttgtctttctcaggaactgagctcatcaaaaacctaccaaataatagtagagtgaagcaggggctggtggttggaaatggatgagtgtgcgggttagtttcacagctcaaaagaaggaaatttagagctgaattgatgcaaccttattcccatgggaataaaagaccctcagaaccagacggatattatcataatataactattatgataataatagtgtagagcagtgcttctcaaactttggtgtaaatttgaatcacctgaagagtcacaaaaaaatacacacacacacacacacacagaggctcaggatcattgaagtaggacaggacctagaattctacatggccatcaagttccccaagttattctgacaccagccactggaggttaaaaatatcagctttggtgtcagacagactcaggttcatagcttacctctgctgcctgccaactagctgcaagacccagggcaaatttcttactctaaatcctgaactattcttctgtatactgtggcagatgacaggaccaaccttatagggttgtgaggattaaatgagacaatgcataaaatacacagagcacagtgcctcgcacatagtggacactagacacctagcagttgctattcttgttttttctactattgccagtggatccaactatattctaatgttggaattccctccccaacagccccactgtgggatcccatctctccctgaattctttcaaatgatgtggactttgacctcactgaggaactaaaaagttaaaaagttcttttctatggatttaaaatctatgtcctttaaattttaactggataggtctcagatatatcattagagatacaaaaatatgactaactcctcttgcatataagagttattcaaatatttcgaaaaagcgaacatggtccctctttttccaacatatatgcatcgaaatatagctgttatagtcttatcacatgaaaggctataggttaaacatcagatatcttgagagtaaatttctccaagtctcttactccatccttcacaacagtaggcttcaaattcaattttggtcattcctgtcctgtctcaacacacaaaaagggctgtcccagagaggtcaaatccagtgcaatacagggaataattttccaaggttgagccccactgatcatgaaacagatagtttcaagaggtaacaatctccctgccagaggaagtataaaaggaaaggataaacctcaacttaggctgggaacagtggctcatgcctgtaatcccagcacgctgggaggctgagctgggcagatcacttgagcccaggaattgagaccagcttgggcaacatggtgaaaccccatctctacaaaaattagccaggtgtggtggtgcacacctgtgctactcagcaggctgaggtgggaagatcacttgagagcccaagaggtggaggctgcagtgagccgagatcacgcctctgcactccagtctgggtgacagagtgagaccccatcaaacaaacaaacaaacaaaaaacagaaaagaaaagaaagacccaaacctcagcttagaagtgttttagaggagttcacataggacaaattccagtttgatagcatcctccttgaaacatgaatctcatgctctaggtgtagacttcacagaagaatgacagagggcatactcaaatgaggacaatttgaggaaggtttatttataaaaggtctgctgataaaggtgacaaatgtatagagacccataatatactagtgcctcagtaggagagctgtttattacctatgggaccagaggaacaaatagaggaagcagtaaccagagccccaaagaagagagctgtgaaaaggaggtaccctgaacagaagcagcggctttctcttgaaaggcccagccagtcatagacaacctgacagggagagaaccagaggcaaaaaaaaaaaaaaaaaaaaaaaatgccctgactacaccttatgcccttcctctggtcgcctgtggcagttctcactagctgaacccaacaagtcagaagtggcaagtgatctttttgacagacttcatacagaatgcactctggaagcagagagcacagtagagaaaggtggaaaggggaactggatccaggaatcccaaccaagaagagaaaagttgcgtgtgtgtgtgtgtgtgtgtgtgtgtgtatgtatgtgtggacagtgtcttattctgttgcctacactggagtgcagtggtgcgatttcagctcactgcagcctctgcctcccaggctcaagtaattctcatgcctcagcctccagagtagctgggactacaggtgtctgccaccgcatccagctaagtttttgtaatttagtagagacagcgttttaccatattgcccagggtggtcttgaactcctgagctcaggcaatccgcctgcattggcctcccaaagtgctaggattacaggtgggagccaccgtgcccagccgagaaagtttctttatacgtctcgttttggccataatttggagaaacatgtagcctaaaatggaattctttattcactaatttttttaagttggctcggggaaagaaaggcactcaggaagaggaatgcatcttttcattataatgctttggccacaggcacactgttctaccagtaaaatgattccaggcagatatacaacaagaaatgaagcattggattggtcagacaattagacaggggcgggggaatgccaacgaaagaaaaatgagcaattctgcttctgatgacattttgaaattttattcttcatttattatcaaaaaggagtgtgtttaaaaatgtatatgtgaccttcttaatcataaatttgaaaagaaatatagcagattctttgcttctatctgagctctgctcacattgccccagcaggaaataaaaggaaatctgataagagagttaacttaaaactataaatgagtatgtttcggaggctttgatatttccttaggggcagaactctcaaccaatctcattccattcagggtaaagtaatatggaaagggttgtcttaggcacagatcattggttttcaaaggaatcataataataatgaaagccttgctgcttttatgaaaaatggtactttatagaaatgtttgggtagctctgaacacctgtattaaaaaaagaaaaactaagcatccccaaaacacatatttaaaaattggaaagctaactgaattgtaaaaatatcagatatattacatccttagtatttaaagctgatggctgactctgtattttcatggtgataataatgttatataatcattttaatgtatggatagatgttatggcaattggcaaagacagctacaaggtggaaatggagggggtatttgtggaaggaaataaaacacaaaaccacagtttggggatctatatctattctttcagaattctgaatttaagtgttaaaaagacctctcagtaacacagaaaaattgacattcatctccatagccaaataatttaatttactacctcattatttttctctctcaacgaaagagaaacccaaatctgtgaatagggcaaacaagacccttaaactaaggactgggcttcaactcagtcttattctctgcacataaccttatcctcccctttcagaaaacatcaactacctcctcccaccacactatttctcaatactccatattccttgatgtgtccctcttcttctccactggtcacctcctctttgtcctccaaggctcaatgtaagtgtcacatctcctctgaggcttctccctgctcttctacatagaattataattttctcctcttgcttgactcatccattgaacatgtacatgtataagtctctgctaaatactagaagatcatgtcttcttgaccttaatccacatggaacatgaagactaatggcaaagacgggcattaaacagataaatacagagacaaaaatcacaaagacgatgaacaccaagaagaaatacctgttgctatgtaagagctagaacctggtttgaaccctggcagcagatcagggagggttttggtgccatgttagctacgtacttgttgagtcaaattgcagtgattcaactctttcacctactacgacaagaacttcttgggaaagggcttttgactctttgcacctactccaatttcttgctgagtgtctggcacatggctcaataaacttgttgcacgaatttatacttaaaagtctgcaatttggagtctagaaaagatagtcctcttactctgaacacaaattacaaccactttaaaagtagatacgtgcaaagaaagagaaggaaacgcctgcataaaattagctggtgacctggaatattcgtaactagaaatattttgggcggtaacttagcatttccttcttggaatgtttgcagaattaacaaaatattcatgggagtcagagatttcccccgcagagcccacaaaatagctgcagctatagcatgttgaagaagaaaaaaaaaatctcatgcaatagtcatatgactcatgggatgatcatataattcatggaattctcagagccttcaaaactcaagtacttatgactttctgaactgaggatttttttctgtagttgctttgagatttttgccaactgggtcacacaatttcgccagcagggggtaccaaaagctgataaaaagagagtatgcataagtctgtttattcctttgcaggaacatttccaaagctgaagactgttttaagacacagcaatccaaagtttactgcttctgacaggtgaggacgaggtgacgcggccatagctcttggcattttccttctaacggatcactttgagctctctctgaccttcgcttgttagctgagggaggggtaggtggcaggggatgggcccaggatggaccatgagtcctgtgatttgttctgagtgccactctttacaagggatactggcaggtagaatggctcacgggagaggaatgaagggctgttaaaagtgtggaaatcatgctacgagaggaggagtgcgtgaaacatccagggacatttctcacggagagggaatacaaagtaacgttctcttcatgcatctgatggttgggtctctatggtcccaggggcagaatgaggaccaggttggcttgatacaacgaaggaatttctttttttttttttattatacttttagttttagggtacatgtgcacaacgtgcaggtttgttacatatgtatacatgtgccatgttggtctgtggtggggtggggggaggggggagggatagcattaggagatatacctaatgttaaatgacgagttaatgggtgcagcacaccaacatggcacaacgaaggaatttctagcaaagtagaactgcttaggtctcttttggaagcacctaacgcctgaattcccctccccaatttttctggtttagcaaccttctcttcaccttttaaggcccaactcaaatgtcccctactcttagaagtctttgcctccttcccaaagttagaagttccctcctctttgctcattaatttgttggacaaatagttaatgagcaagtacgttgaatctgtggctgttagaaggaaggagatgatgatatgaaaaacaagacaggaatcctgccctgtttggcttttgcaagtactcagctccctgctattggagaagttcaagtagagactgggaaaccacttagaaaagaggtggtggaggatcccaggatttggactctgcaaaacccttgactctcttctgggctaggaacaggaccatccagccaactggtgggggcaggagtctacagggttccacctagagtttttccctgaatgtgggagccatgcccactctcctggggagacactgatcaggcactcttcctcttccccatagggctcctcctctgggccatcctccattgcaatctccagataaactttcctggaaaccatgaagattgaaatcctggagtcagagatctcagccataggaagtggaccaaaaaaaaaattcacaagtgaggccctgcttctactaaaagctggcactgtcctctttgaatccaggatgctctgctggcatgactagatctcagcttaaagttacacatcgcaactgtaagggaactatagcatcttctcatttcatagacaagacactgaggcctggacagagtagtcccttagctaagatgcacagcatgtaggatgcaagccctgctttctgcctgccagttcaggaatgtggacacctgctccacattcctccatgcttcttctagggatttgcccttccagattagaagggcaaattcagtctgtggtacacatgattccagtgtcttacaaatgcagcaaaactttattcatctatgcccccactgactcagaattactgtaattgaggcaaaggctgagctacatcacataagaatcaatagtgtagcagggggaggagccaagatggccgaataggaacagctctggtctacagctcccagcgtgagcgacgcagaagacggtgatttctgcatttccatctgaggtaccgggttcatctcactagggagtgccagacagtgggcgcaggtcagtgggtgcgcgcaccatgcgcgagccgaagcagggcgaggcattgcctcacttgggaagcgcaaggggtcagggagttccctttccgagtcaaagaaaggggtgacggacggcacctggaaaatcgggtcactcccacccgaatactgcgcatttccgacgggcttaaaaaacggcgaaccacgagattatatcccacacctggcttggagggtcctacgcccacggagtctcgctgattgctagcacagcagtctgagatcaaactgcaaggtggcagcgaggctgggggaggggcacccgccattgcccaggcttgcttagataaacaaagcagcccggaagctcgaactgggtgaactgggcggagcccaccacagcacaaggaggcctgcctgcctctgtaggctccacctctgggggcagggcacagacaaacaaaaagacagcagtaacctctgcagacttaaatgtccctgtctgacagctttgaagagagcagtggttctgccagcacgcagctggagatctgagaacctgcagactgcctcctcaagtgggtccctgacccctgacccccgagcagcctaactgggaggcaccccccagcaggggcacactgacacctcacaaggcagggtattccaacagacctgcagctgagggtcctatctgttagaaggaaaactaacaaacagaaaggacatccacaccgaaaacccatctgtacatcaccatcatcaaagaccaaaagtagataaaaccacaaagatggggaaaaaacagaacagaaaaactggaaattctaaaacgcagagcgcctctcctcctccaaaggaacacagttcgtcaccagcaacggaacaaagctggatggagaatgactttgacgagctgagagaagaaggcttcagacgatcaaattactctgagctacaggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcagggtattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactcagcttcataagtgaaggagaaataaaatactttacagacaagcaaatgctgagagattttgtcaccaccaggcctgccctaaaagagctcctgaaggaagcgctaaacatggaaaggagcaaccggtaccagctgctgcaaaatcatgccaaaatgtaaagaccatcgagactaggaagaaactgcatcaactaacgagcaaaatcaccagctaacgtcataatgacagaatcaaattcacacataacaatattaactttaaatgtaaatggactaaatgctccaattaaaagacacagactggcaagttggataaagagtcaagactcatcagtgtgctgtattcaggaaacccatctcacgtgcagagacacacataggctcaaaataaaaggatggaggaagatctaccaagcaaatggaaaacaaaaaaaaggcaggggttgcaatcctagtctctgataaaaccgactttaaaccaacaaagatcaaaagagacaaagaaggccattacataatggtaaagggatcaattcaacaagaagagctaactatcctaaatatatatgcacccaatacaggagcaccaagattcataaagcaagtcctgagtgacctacaaagagacttagactcccacacattaataatgggagactttaacaccccactgtcaacattagacagatcaatgagacagaaattcaacaaggatacccaggaattgaactcagctctgcaccgagtggacctaatagacatctacagaactctccaccccaaatcaacagaatatacatttttttcagcaccacaccacacctattccaaaattgaccacatacttggaagtaaaggtctccttagcaaatgtaaaagaacacagaaattataacaaactatctctcagaccacagtgcaatcaaactagaactcaggattaagaatctcactcaaaaccgctcaacgacatggaaactgaacaacctgctcctgaatgactactgggtacataacgaaatgaaggcacaaagaaagatgttctttgaaaccaatgagaacaaagacacaacataccagaatctctgggacacatttaaagcagtgtgtagaagtaaatttatagcacttaatgcccacaagagaaagcaggaaagatccaaaattaataccctaacatcacaattaaaagaactagaaaagcaagagcaaacacattcaaaagctagcagaaggcaagaaataactaagatcagagcagaactgaaggaaatagagacacaaaaaacccttcaaaaaattaatgaatccaggagctggttttttgaaaggatctacaaaattgatagactgctagcaagactaataaagaaaaaaagagagaagaatctaatagacacaataaaaaatgataaaggggatatcaccaccaatcccacagaaatgcaaactaccatcagagaatactacaaacacctctacgcaaatgaactagaaaatctagaagaaatggataaattccttgacacatacactctcccaagactaaaccaggaagaagttgaatctctgaatagaccaataacaggatctgaaattgtggcaataatcaatagcttaccaaccaaaaagagtccaggaccagatagattcacagctgaattctaccagaggtacaaggaggaactggtaccattccttctgaaactattccaatcaatagaaaaagagggaatcctccataactcattttatgaggccagcatcattctgataccaaagcctggcagagacacaacaaaaaaagagaattttagaccaatatccttgatgaacattgatgcaaaaatcctcaataaaatactggcaaaacgaatccagcagcacatcaaaaagcttatccaccatgatcaagtgggcttcctccctgggatgcaaggctggttcaatatacgcaaatcaataaatgtaatccagcatataaacagagccaaagacaaaaaccacatgattatttcaatagatgcagaaaaagcctttgacaaaattcaacaacccttcatgctaaaaactctcaataaattgggtattaatgggacgtatttcaaaataataagagctatctatgacaaacccacagccaatatcatactgaatgggcaaaaactggaagcattctctttgaaaactggcacaagacagggatgccctctctcaccactcctattcaacacagtgttggaagttctggccagggcaatgaggcaggagaaggaaataaagggtattcaattaggaaaagaggaagtcaaattgtccctgtttgcagatgacatgattgtatatctagaaaaccccatcgtctcagcccaaaatctccttaagctgataagcaacttcagcaaagtctcaggatacaaaatcaatgtacaaaaatcataagcattcttatacaccaacagacaaacagagagccaaatcatgagtgaactcccattcacaattgcctcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagttaccaatgactttcttcatagaattggaaaaaactactttaaaattcatatggaaccaaagaagagcccacatcgccaagtcaatcctaacccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactgtctgatctttgacaaacctgagaaaaacaagcaatggggaaaggattccctctctaataaatggtgctgggtaaactggctagccatatgtagaaagctgaaactggatcccttccttacaccttatacaaaaatcagttcaagatggattaaagacttaaacgttagacctaaaaccataaaaaccctagaaggaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacgggcaacctacaaaatgggagaaaattttcgcaacctactcatctgacaaagggctaatatccagaatctacaatgaactcaaacaaatttacaagaaaaaaacaaacaaccccgtcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggccatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacatatgtttattgcggcgttattcacaatagcaaagacttggaaccaacccaaatgtccaacaatgatagactggattaagaaaatgtggcccatatacaccatggaatactatgcagccataaaaaatgatgagttcatgtcctttgtagggacatggatgaaactggaaaacatcattctcagtaaactatcacaagaaaaaaaaaccaaacaccgcatattctcactcatagatgggaattgaacaatgagatcacatggacacaggaaggggaatatcacactctgggaactgttgtggggtggggggaggggggagggatagcattgggagatatacctaatgctagatgacgagttagtgggtgcagtgcaccagcatggcacatgtatacatatgtaacatgtaactaacctgcacaatgtgcacatgtaccctaaaacttaaagtataaaaaaaaaaaaaagacaaaaaaaaaaaaagagttcaatgtgttgggaagtcacaaagtataagtaccatgctagtgctaggaaaataaagatgacccaattagtcttttttctcaaaaaaaaaaaaaaaaaaaaagaatcaatagtgtaaatagggatatggatgtgtgcagcatttaaaggagaatgcactgttttccctcgtatcaggaggcaggactgcatagcagttaatatactggctttggtgccagacagcctggcatcaaaatctggctccatgtcagactagctgtgcaagctcttgcaagttactgagccctctgcatgccagtttcctcctgcctgtaaaacacggattagagtagtacttcccccgtcagactgttgggaggattgaatggtatgttgctggtaaaccactttgcccagggtatgcacacagtaagcactcaataaatgctctctggtatgatcatattttaaatacaaaaaaatccatgttagtttaaataacctcattatttattaaatatgaatactttgaagtggatgccctggataatgacttttctttaaaaacctccattgatgcagtctagagccatgcttttcagctttggctgagcacatcatttggggagctttaaaaattaccagtgagattctaatttaattggtctggggtgcagcctgggcatctgggcattcagaagctttccaggtgattatagtgtgccactaagcttgagcaccaccgatgcggaacagctgttctccaagtgtggtttccctggaccagcagcatccgcttcacctggggatgtattagcaacgcaagttcaccggccctgccctgacctactgaatcagaaactctaggtgatcaataagccctccaagcaattctactgcatgccaaagtttgagaaccaccgaagtaggtgggcccactcttcagcaggtctgaattagtaaagtttcattcttgaaaatggaacactagaaggtaagagacccgggtgccgggtccagatctccagatatctcattgagttgccgtgaacactccctttcccctctctgtgtattgatttcactatagtgggggagttggcatctaagaatcatggcaacaactgatgcttttaaaatgattgttatggattgaactgtgttccactcacccactctctggccgcaaaagatatgttgaagtcctaatccatagtacctgtcaatgttaccttatttggaaatagggtctttgcagacgtaacgaagttaaaatgaggtcactagggtggctctgattcccagatgactgatgtccttacaaggagagggaaatttggacagaagtgcactggaagaatgccacatgacaacaaaggtggcgatgggagtgatgagccataagccaaggagcacggaggactggtgggcaccaccagctgccaggaagaggcatggcaccattctatttagagtctcagagggagcctgacccctccaacaccttgattttggatttatagcttctaaaattatgagaggacaaattttggttaagtcatctagtttgtgagacattggtacagtagcctgaggaaactaataaaatgaccataattcctaaattgatgttatttgtttaataaacattatagagtacttattgaataccagccactattcaaggcctttataaacagggtattaagttccttaattctgctacaacaccgtgaggccaggagtattattagttccattttacagataaaagaattgaggcagagagagttgaagtaacccatggaaagccacccaggctttcagaggcagagctaggattcaaaccctccagtcaggcttctaaatgttctctaagattccctgttatgtcacgcttaggcaaaaagccatcacatatctccccttgtcctaaagctttctcagctgtctccctttctccccaggcaaacacacactcacacatatgcacatacatgcatagacagctgcggccagaaaactcactcacaaccactcatgtcctgcaggcaatgagcatcctgtctgctcactgcctctgttgggtaccaattctggggcatagctggtgggtcctttccctcctgccccatcaccctcatctagggcttgtgaatcccccagcatggcaaagttacagaagcaacagcagcagcaacagcagcagcaacagacgtcatgacaatttgaaaggccaaaggacttggtcttctacttccattgctttgctatcttgctgtccatatctgtgcctctatctgtctatctctgcttctttattctgcctgtgactacctctctggcctggatgggctctcctaccaatcacactctttccacttaggcaatagtcagaccctgttggaccattctctgcacccagcagtgaaatcagagcagcagaaagcccgaaacacaggtgaggccctcctccctctgggtacatggccatactggcccctgggccctaaagcagagcctaggaatagcactgactttggagccacactgcctagactgaaatcctggctccatgatttattagatgtatagtcttgggcaattgctaaacctccctataactcagttttctcttctgtcaaatagggataattataatgaattctcttagcaatgctttgaggtagatactaacttataattatgaaagtacttaactgggatctgtcacctaccaaataagctctacataagcatttgttacataataggtgataagaaagaaaaaagtgcttcaaagcagagtgtgaccagaattcatggttcagacaatgggagcttccctgaatgaatgctgtctgagctctgaacccctgggttggggagatggcccctctgttcttggtgttgcagaaataccatgggctctggccctggactgacttggctcctaacagtggtgtaatcatgatcaggtctccatttctgtgactctgtgagactcaatttcctcgtctatagaatagaatttaatataccctaatttgcagagttactgtgatgatgagaaatgataaatgatgacagttccctagcatggtctttggcatataaagatatgcaacaaatgctagttcttttttatcctccttccttgccccagcaatccgcatgactttttccttgctttcatttttaattttatgtttgatctgcttcccaagatgagcactctagggaaccaaggtgactaatctttcctccctgtagtttcatcttgctctatccatatcctgctcatacgacccgaaaccaaaccagccagtggggcagatgctcttcccctattcatgcgttgaccttcagtttcacatcattaaaagttgtagaatcttggattctctggctggaaaggccctcccagtcattttcccaccctagctaggagactccttgcagcatccccagccagtgggtatccagcccccgactgctgaattccagcaacccaaactcatcacctctgtgggcagctctttaacagactgcagctccctatatagggccattccttgctgagctgaggctgagctgaactctgtctcctgaaggcctcaccctttagatgctcctcctcggtctgtctgctatatcccaacaaagcctgtatgtggatagatgatgaccatgaattcttcaagctttatcccaagcaaccgcttccaagcagcgtctcctggttgctgaggctttatggctatttccctacagctgagtgaacctccttctccgttccacactcacatgcccacatctcttctcagatctcaaaccaggactccagggtgatctccctctcaccagctcacaactgcctcctctcaccctgaccccatcttagaccttcagttgccaactagaaacatcatctccttcttgctgaatggctaacttacagggctattgccctgctagactataaccacaaggacaacaacctttttggccttgttcactaccaattccccagggccttacatagattttggaacaagcgggtatcctgtaaagacctgttgaattaacatattaagagatgatcacaagtccttcaaatcccattcaaatcatcacttctttcaggaagccttttctgatctcttcgtgatagggtaggccttgcttctgttttgtatcccagtcatttgcctatcttctctcatcacttttcattataatcaaggtacaaaatatacatatttgcgtattgtatttgtatttcctttagcacatagtttagcacttcccacaatgttgtaaaagctttaaacatgtttatggaatgaatgaataaattgagtgacactttccattcctttattgttgcatcgtcccatatttgagcttccccgtgtctacgacttgacccttttcatcaatttctgcaccaaatttctgtatttaagcagggtcctacttactattctacaagttggctttcttctgcaggtagtgcatggcaatgattctcagacttgagtgtgcatcagaatcaccttgttaagcaggcattgttggtctccatcaccagtttctgatttggtaaatcaggggtgagtgcaaaaacttttcatttccgagttcctaggagacgctaggttctatattttgagaactactggtctatggaatgccatcttctgccccagaggggatcacataccatttatcttccaacttttcttcatcagtcacctcaaacattacatccaggccaggcgcagtggctcatgcctgtaatcccagcattttaggaggctgaggcaggtggatcacctgaggacaggagttcgagaccagcctggccaacatggcgaaatcccgtctctactaaaatacaaaaattagcccggtgtggtgacacacgcctgaagtcccagctactggggaggctgaggcaggagaatcacttgaacctgagaggcggggaggttggagtgagccgagatcacaccaatgcactccagcctgggggatagagtgagactctcaaacatacacacacacacacacacacacacacacacacacacacacacacacacagaacattacgtccatcccccactccaccccaaaactgtagatgggcataagaccatctatcctttaatccacaattcccatttttctagaattttatcctaaggaaataataagaaggaaaatatacatgtatcatgtaggtaccactggaaacacagcttcctctatgccaggatttctcaacctcagcactgttggtattttgggccagataattatttgctacgtatgtgttggggagttacctagtgcactgcgggatgcttagtagcatcctccttggtttccaccctctagatgccagtagttccccctactcccaggcatgtcaataaaaatgtctctagacattgcaaaatggttttctttttgggtaggcagaattgcccctactactggcatagttaggtaaatgtaacagtttaacatttagcagatactaccatgtgcttagtattttaaacatagctccgattttcacaacactaacaaggtagtgattatttcttttgttttataggtgaggaattcagggcccagaaaggttaatcctaaactcgtaaaacaggtaaagggaacaggtgggatttgagcctagctcttcagcctgctgagagcatgctctcctcctcacccaacttggctgcctttctttaatagcaaatgatcggttaaagcctcgtaaatgtctaacaatagggaactggttcagtaaattatagtgcatcccctggatggaatattatgcagccattaaaatgatggagggccattaaaaatgaaaaccatgtaacgacatggaaaaatgctaactggattacattaagttaaaaaaactagaaaataaaaatgtgtctacattgtgattacaacgatgaagaagtatatctatgtgcggatggctcatgtgttggattgaggatattaaggataattttcctttcttctttgatatccattattgttatcagagtgtcttcatgatcctaatttctaagtagtagcagagtaatgataagattcaagatgttaggtttgccctaggcccttcttccacctgaattagaatgaagacttctctaaactctgactatagcaaggggttgatttacccttactttccctcctattagcactgttgcatgtatgtttgtgaccccaggcccctctccttgcactgaccagcttctcccaagcacagaaagctggaagcatagaagaaaacaactctgaaggcattggtgtgaatcactctgggagccagggctattaggaacatacagtcttagagtagcagatggcatctgtctgtcacagggtactgagcggtgcactgtctcatgcattatgcatcaagagtggcctagcaccctggcccggctgtgtgggacaagtcttgcaaaagaaacatctgatgaactgatcgggatgtcaaaatgtcattaaggataaattaatggatgtgttactttggctgtaagaggcagtgccagcaagacaacagacagccggtgggctgttctccagcccaagacagacggcgtttgcaatggagattcatggtctttatgcaacgtgaggtgctttgcagggagaagaataaacagaaatgctccagcacttaagcgccataaaatcacaagcatgagattaattaattagtgtacactaggaaggcggctggtctgtctgcgctcctggggaaagctagaatggatggcactgggttagagatgacgggtccctgcaccagcctcctaaagaaaagcaattgaatttaatgtgcaatcataaactgccgctgatggaaagataagtctggtcggtgtttgttttttcagggatactatttctgcctactgcttcaaacactttgtgtctgtgggtcaagtatctgagaggactggggagacctggaaactagttctgcttataacgccatgtgggctatgaagggtgttataatctcaacacatagagcaactctcagggaagcctgactccccctgcgcctttctagatagggggttgtccattcttctgtgataggaggctcaccacttccctttcaacctgacccagtgttagataagcattgttagagagttcttccttagacttccctagcctcttcctccttataacttaacaacaacaaagacaagaaggagaatagctaatgcttactgagtgcttgctgggtgccaggcactgggctctggtcaagttacaatgttatcatgtattatctccattttgcagtgtaggaaaaagaagaccagagggtgtgaaagacatgctgaagatcgcacagctagtatatggtagggccaagatccaaacccggggctgcctgaggccagggcttgacagcttaactatcacatggttctaagtcctgtaactaccattaattggatggagcctggcttttagagcaatacagaatatgacaaggcaagacagatgagaactcacatgtagcacatattgggcactgctaagcacctggcctgggtcagcctaacacatcgttcatgcagtagccttttttgagtaacgaaattatttccccatctgagatatctattttcttatctttttaaaaaagttatatatatatatatttttcaacatataaaaatcggtttcacttctgtgtatttataatgaacaattagaatctgaattttcataaatagtacaatttacagtagcacccaaaaaagaaacattcagatataaatccaccaaaatacacatgggacctacatgacaaaaactataaaatggtgatgaaagaaatcaaagaagatcgaatcaaacaaagagacatacatgttcctaagctggaagactcagtattgttaagaggtcatttctcaccaaattgatctacagattcaatgcaaacccagtcgaaactcagcaggatattaacaagcttgcggatatcaacaagctaaaatgccattgtacatttatttccaaaaaagaacagggaggcaggtcgtgatgggtcatgcctgtaatcccagcactttgggaagctgaggcaggactgtttgaagccaggagttcaagaccagcctgggcaacatagtgacaccctctctacaaaaaaataaaataataaaaataaaacacattaataaaaagaatggggaaaaagcctctaaaccgcacatgtccagaaaatataacatgaaacattgttatgtataaatatcataatcacttaggtacattgtttaaataaagttttttatgtatgtctgctataactaaattggaataaaattctctccaaggtacaaccctttttataggatactataaacaaaaacgttaagagacaaaaatttactcaatgaagtttaagcaggactcaagaggccaatttaaaaaacaatgaacgtgaccccaaccgtatcctctctttaatcttggtcctatttctccaatgtagatgataaatttcataccaattgtgaaacaacgaatgatcttgctcctgttttagggacagtgagtatatttaaagaaatgatacagttggtagagtttttttgttttctgttttttgatttttgagatggagtctcactctgtctcccaggctatgagtacagtggtgcgatcttggctcactgcaacctccgcttcccgggttcaagaagcaattctcctacctcagcctcccgagtagctgaaattacaggcatgcaccatcacacccagctcatttttgtatttttagtagagatggggtttcgccatgttggccagggtggtcttgaactcctgacttcaggtgatccatccgccttggcctcccaaagtgctgggattacaggcatgagctactgcatctggctagttggtagaattttttatttggttggtatattagtccattctcatactgctataagtatactacctgagactgggtaatttataaacaaaagaggtttaattgactcacagttctgcatggctggagaggcttcaggaaacttacaatcatgacagaaagcaaaggggaagcaaggcatatcttacatggtggcaggagagagacagcatgcaagggaaactgccactttttttttttttgagacagagtcttgctctgttacccaagctgtagtgcagcggcatgatctccactcactgcaactcccaggttcaagcgattttcatgcctcagcctcccaagtagctggaaccacaggtgcatgccaccatgcctgactaatttttgtatttttagtagtgatggggtttcatcatgttggtcaggctttctcaaattcctgacctcaagtgatccacccaccctggcctcccaaagtgctgggattacagatgtgagccaccacacctggccaaaactgcgacttttagaaccaccagatctcacaataactccctcactatcatgagaatagcatggagggaaaccacccccaagatccagtcagctcccacccattccctccctcgacacatggggattacaatttgagatgagatttgggtggggacacagagccaaaccacatcagttggttttcatcttttctattgtaatttagagcaaagggtaagggctagctttggaccctttcattgcatctttcccctgcactcagacctgtaaagtgcttctctctggggcaggggctgtaatacttaccagcctctttcagaatccctgccacagccaccctcaattcatgatgagaacacagcactagtaattagcacatctttgttccacgggtttcttccttcatatgacctgtgcccctgctcagtgtggtgagacttcatttccttacatttaaaatatttcctcattggagtgactcaaagatttcatgagatacctgtggtgtcatgcaatatatagattggatttgtccactctgcctggtttataactcccatattccttgttacagtcttttgctataatgttgggtgtgttagggcccaggggaaggcctcaggtgatacaccctctctccttccttcctttcacttgccccaaggcaggactctcatcttcccctgtctttctgattgtgggtcttaagaccttcctctgagagggtcccacctcatacccagggggaggaatgctgattttatgaagctcccctaagaacctatgagggctgcgtttggagagagagcttccagatagctgaacgcgtggaggttcctggatggtggtgccccggggaggttatggaagctccatacctcttcccccaaaccccaccctatgtgtctcttcatcagtattatttgtaatatgctttataatagaccattaaacatgtttccccgagttctgtgagctgctctagcagctctagcaaattagttgaacccaaagaaggggttgtgggaaccccaacttgaagcctgttggacagaaatttcagaggcccaggcttgtgactggtgtcttggggaatggggaacagtcatggggactgagcccctaacctgtgggatctgacactatctccaggtaggaactgaattgtaggacacccagctggtgtccgctgcttgatgtgtggggaaaacatcccatacatttggtcacagaaattctcttccatgttgatgactgtggtagtgtgagagtagagaaaaaatgcagtgtgagagagtttttcttgacacaacacttacgtgaaagtacttggtaaactgcaaaacagcagtagacagagtaatataaaacataaaatatactaataataactacaaggtactgagcacctactacgcgccagatataaaaaccagatgtcgtatatgcattcaattatcttatgctgtcctggtaaatccccacagcaacagcccacatttggtgttattgtccccaatttacagatgagagaacagaggctcagagaatttaagttagtaagcggcaaagtccaggattcaaaccccaacccagtccatgctcttttcgctacaatgctgcttccaggtgttgcttattgttttcctcaccattcagagctaaggcaaaagcactgtttaacgcccttaaggaatgaaagatgagattacagaagtacaatttttgagcaaattgccccttgcctacatggctggaaaacacatcacagtaaaacagtcaatgtgtatacttcaaatcagccacagatctggaaaaaccttagatcccacaatttcatggtagctctgctatataaagcaaagataagaaaaaataataatatgaaatcccgtaccaaccagatatgagcttagatttttcaccaaaaattctcatctggtagattcccaaatcaaaattggtatggggaaggaagaatgaaatgaagtatgaagacttagcttttctccacttctgaaaaagtccattgttgctaagctgttttcccaaacagaataagccttctttagtctcgaggctcaatttggtctacaacattaataaaacgatatttacaatctttacaaaaatcaagtctttcattaaaaacagggttttgaccacactaatctttccattcttccacttaaaaaacatgggtggttgtaatatacccaccaattcccaccctcttagaatgttctgcactgtggttcaaagcccttagaataaaaaactgctccagaaagcaactcagccaatgttcttttattctgttaagaaagagatttcatcagcagaagcattgagtcccttgaggcttcagggatagaggcttctgaacacacatttctgaggagataatcatggtggaggtgactttactcctcataatgcctccaaaaccatcatgagtagtgattgttgcaagaaactaaatactatttcaaacgtatgtgctcagggcatttttgccctttattaaatgacctctgtacatttatgaacagtctaaggattgtctacctcaatacctaaaaaaggaaatgatgccaccaaatagcatcttgacttctacagattttactttccaaactcaagttccatcatcatactcaaactcatgtttatctgatgattgtatgggaccaaattctcaactaaggttctgggccaaatggccaggctaatgcttcacgatgctctttcaaatgcctttatttgatagccctggattctcaagcccttccagatgggtggttctcaactacggtttcagattagaataacctggggaactttaaaatgtctaggcactacccctgaccagttaagtcagttctccaacctctctttatagactgtggcttggggtcttctccctagctgagtgccctcccgcaaatacaccaactcctctaagctctgttcccagaaaggcaacatttctaatggcattgttcagaatatggtggcctctctcgaattctgacaaccttgcctttttaaaggaaggtgttgccagccacatctcaataaacaagcctgtcccccagcccttatatttggaaatggccatggtagtgcactctcccgaccccattcaaccccagctctttctctgcccaccggtctacagagtcttcttgtataaaaatgacattgtcttcctttgtagttctagccaaaatcattagttatctcttttctttcttgttgatatcaccacgggtggatgccaggaggagggttgtcttacccaattgcttggaggggaaaaatctgtgaagtttaaggaacaccatctaaaatcctcctacttcattctattttcaaattcttcttctacttaacctatatctgctagttacaattgatctctcctctctcctctctctctctctccctccctccaatatatcaaaccactgctttgttctagcctagctctataatttcataaatgacaataattcccctggcaagtacactgtattaatttcttaagataatcccatgaattgaacactaccattcccattttacagatgagaaaactgaacctcagagggtttaggattcacagctactaagtagtataaataggattcaaactttctccctacccctttctttccctctctatagcattcctttcttccacttctttgcctttttaagtttttttcctagcatgctatcaaattaagttatgaaaaaaagtgtgtttctgtgtgtgtgtgtttcaatgttatgaggccgaggagaaaagtgaatgaatgtgtcattttttatttatttattttagacaaaatctcactctttgtcgcccaggctggagcgcagctgcacgatcttggctcactacaaaccccgcctcccggcttcaagcgattcctctgcctcggcctcctgagtatctgggactggaggtgtgcaccaccccaccaggctaatttttatatttttagtagagatggggtctcgccatgttggtcaggctggtcttgaatttctgacctcaagtgatcagcctgccctggcctgccaaagtgctgggattagaggtgtgagccaccgcaccaggccaaatgtgtcatttctttaaggaaacatctggcatctactttataccaaaaactttactgggcccgttaacccatggtatctttcctcaaaatagaatcagtgacttccttgcctttgttatgtcttcactgctcctcttttcatgcacttgtaacattattttgtaacgttttattaacacgttcaagttccttttaagctgcaagctccttgagagggtatttcttactaaagactcaacaattttctctccttagcacaagggaattgctcagcaaatgcttatgaatgaaataatatgtcatttaaacatcagagctattgtaaaatgtaagtggtatgactcccattttacagatgagaaactgaagttgagatggaattaagtgagttatctaaaactgtggagccaggaagctcagggctttttcctgcttggcacagtcatctatctaataatgacttccgaaatacctccaagcttaactagacaactaggtaataagtgggaaagcactttggaagagataaatccctaaaaacaaacaaaatgcaatcattagcatcatcatcaacattgaggggcttaactaaagcatttccttccattaaaagcactattttgaaacacttagaaaggcattttccagtttgtgcatctcaggatcccatctttgctacagctctagctgtaagagtccttcccatttgggggatgcttgctgaaggtagtgctttcggaagtaaacccaatcctgccttggagacatattgctaagtgggcactgtggctgggcacttctgaccctggttctctcctctggctggatcagcaaaagggtattgctacggtcttctctgtgatacatcttcagctcccccaagcaggagctatgtgtgaagatctctgtggctctcaggtccagcacaagcacaggtgaacagcaaatgcctatgaatgaatgatcgcccaaggaaaaacattttagagtttatgtattatcagtgggcaacaaagtaataaccccaatcagttggtatgcagagtgttcataagcaatgaagagtgcatttcagtggtgggaaacccacttgtctccagaaaagccaatgggagagtcccaagctgggttctctgaaaatcaatcagactctgagagagattgacaagcaggagatgtattggggaagcttcacctgtagataaaagggaagaggagagaaggggaagaggaggaagggaagaggaaagaaggagggaaggaaagggaagggaaaaagaaagggagtgggcagaggaaaggttgaatggtgatgcagttggagcagtggctaaagccaaccccaggggaggccctgaagctggggttgcttttacaccctgtgtcaaccagtgagtagatgactttgagtgaggcggctccaaagggcaagttctgaaggggggctgttagtgtcacaaacaagtgggtttccctcccctgaaatgcactcttcattgcctatgaacactttgcctaccgattggggtcattagtttgttgctcactgataatacaaaaactctaaaaagcttttccttgggtgatcattctttcataggcatctgtcagcatcaattgtagcgaatggggaaagtccctcattgtttttttttttttttttttttttttgagacggagttcactcttgttgcccaagctggagtgcaatggtatgatctcagttcattgcaatctccgcctcctgtattcaagcgattctcctgcctcagcctcccaagtagctgggattacaggcacgtgccaccatgcctggctaattttttgtatttttagtagaaacggggtttcaccatgttaaccaggctggtctcaaactcctgacctcaggtaatccacctgcctgggcctcccaaagtgctgggattacaggcatgagccaccacgcccagccccctcattcttgaaggtggatctgagcagcacatcacagagtcctccacaggaattttctttctaaccacactgcagtagggtactcctttctgttagcagagaatctccatactctcattaaccttgtttataaagttcaagtatgtttatgaggtagaagcattaagagtcacagacagtcttttctaagcctcaagacatcactaatacctggttggtattattaggttggtttaaaagtaattgcggtttttgccattaaaggtacattttacctttttaaaatagtaatgaacacaattacttttgcaccaacataataaaacttaaacttaggtataaatttataactgaaatataaacaccttttgccacctttggaggtaaaatttgtatttttcctgattaaagtgacagagcctctgacttacagatttgctctgtttggcatgcgtgactgatgcgtttagacgccagttcaatagagtaaacaataaagcatccgttcagttgcaatccctatccaaatctatcagtacacatggtctagcccagtgcatttatatctattaatatctcattgtaatagcagtcattaattttacacatttataattgtgtcatgcaagtaccaatgcaacatttctaaacctaaaacccatataagactacaaaataggtgatctgaaagctctatcatcaccgtaggccaaaataagtgaacatggatattaactaacttctagagaatagaataatataactcaatgagagacaaaacaaaattggaagggtatcaactccacacatataaccactcatgtatctttgttcattcatctaatcaacacaatcttatgatgcctgatttgtcctgagcactgatctagtcactgggaaatgaatgatgagtaatacatagttctccctacatggagactgacatgcaaagatgccaagggcaggataacctgggaagggatcatgaattagtaagtcaatgggtgaaggaatgaaagataaatgcaacgacaaagatatgagcccagcgctatggatatggtccatggaaattggagggggcctccaaagtagagaacaatgacactccctttataaagatactggagttttctgggcacacaagggggataggaagaattccaggaagaattcactgcagggataaacattatgaaagggacaattaaatcagagtgatgtgaggatgccatgagagttgttctcaaagtcagcaggaaaaataagaatctgagatacttgttaaaaagcagatccccaggccatgcttttaaggagactgagcagatctggggggtgaggctcaggaatcagacttcccaccaaggttctcctcttggctgaagagccacactgctagtaaccactttagtcttgactgcatggtaatgtcttacattttcacctattaacatgtttgctgttgataatttgatatttactagtaattgatatttagcaactttaaatggttttcttctattcctattttttcttcatttttattcaaagtggctgataaattacattaaataacttttgagtatctcttgatggaatcattttaaaatgcctgtttaaatatattgaagcaatgatatctgcttcacagcagctgatgatgtgaaaaggcatttgcctttgaagaaaggagcagtctcttattttggtgaggccctactatgtgctaggcattttacattatgtccattgaatctttgtgagacttcttctgtaagatttgtattttttgtctctgttttacataccaggcaactgagattcagaaaaagttgagtggcttgttcaggtcacacagatgcaaaaatagaagcaaaaatggccttaaacccacagaagcaaggaagttacaaggtctagagttatctaaaaaatgatgtcatttttttttcttttcaagaacagagtaccaccctgttgactttagctgtatgtccgtatgtcttttaaattcatcttgttccttcactcattacacaggcacttactggggttcactgcatgtgttaggagttccatggagaataccctaatgagcaagcaacatccttaagacaaatttgctcctgcccataacataaagcaactgcagttcagagaaaggcgccattcccacaggtggagagaatcatgagagacttcttgtagaaggcagtgtttgatctggactttgaagaatgatatcggatttgaatatattgagatggaggagatcagaaggctatagaaaagcccaggagtcccatggagtatctgtggacagaaaccagcccaggtcacggttttctgcctcggagacatctgcacaaggcatttgtccaaggctaagtgaagtagttacgtgctctctctcagccagaacaattggtaaacaccttcgcgctttctcaagaactactacagtaaaatacctctgttcaaaacaattactgtgcctatcacacaccttgaggtaaattaacctgtggacacatgccaactcttaatatcctttaaaaaggcaaacactgaacaactgaagttgttggggtctgctttactacagaaaggcaaaaagggatcccagagaggcatttttgtcagctcagaatgtgaggaatagtagctgctatttataaaatacctactgtgtgccagccactctacatacacactctctcgttgcccttcaccaaaacactgggaagtcaccgctattatcatgattttccagatgaagaaactgaggctcagagtgtttctatgagtgttccaggtggaaacaatctcacaggagaggcaaacctagaattgtgaaataggcctgacaccaaaacccacatgattcacatttgtgtgtgcgtgtgcgtgtatactggagagacaataatgggccttatctttaactatcctgtgtccctgggtccccagatccctctgttccatagctccatttttattgggctgttatttatcctggtcattaacacccctttcataacctcttgctctaaccctttggctacctctgatgcagcagctcagtgccctcagctctgactcctctcaacatgttgcctgtgcacagcactgcttggaagaccagccacatcatgtggccaatccccaggacagcagagacaggactgccccagcggcctccttaccagcctggaatagctaccacttcttatgcctagaagggcactgatggccatgcacagaaacgaggccctacaggcagacagacttgcatttggtacctggctcttcttcaacctggctgctgtgctccaagcacgtggtccaggcagaagtgcccccatctcccaaagaacagggcttagtaagaagaatgggtagggcttgtgggccatgtggtcctgagttcaaacttaaccctgctgcattctggctgtgagcaatagacaagtcttcagacttcagtcttaacatctaaataaaatcaacaaaataacatatactttgcagggcttgttataagcattgggtaagtatatatagtagggaccaactggtaatgcctttcaacttctgcccttttgtagtctggtatagggtgcgccttattcacttttgtgcctgcaacatcaggcacgggataaagtacatggcaggagctcaataagacaggatgaatcttgactgtcacactcttcctacgctcaaaactctagggcaagaattggcaaactgtgacctgtgggccaaatctggctcactgcttggtttttaaaaattaagttctactggaacacagccacactcattcaaacacatagctatgacttcatgctacaacatcagagttgagtagatgcaacacagaacacaagggtttgtaaagccaaaattatttactgtctggctccttatggaaaatatttgtggaccactgttctcatgtagggatactttcaaagatggagagcacttgatggcctctttattttgggggaaatatagaattcctctgctcctcccccatccatactttatctcctctttccctagtttatttcttcttcttagctcttaccactacatactatttatttttgttatatatgttgtttactttctacctcttctactaaaaaagctccacgtgtgcaggaatttttacttgtgctaactcctatatacccagaaccttgtccaatgcctagcatgcagaggacattccacaaatattggtggaatgaataaacactgatttcattgaagagactggtgagccaaagtgtgttgaagagagaacacacttcaatgaaatcagtgtttattcattaaaaggaccaggtggcccctgatacctatgaggagggtattacttttcctattttatagataagacaactgagactccagttaagtcagtgattctctaacatgcatatgaatcacctgcgaccttgttacaatgcagattctgattcaggggtctgggctggggcccttgatgctacctctctgacaagctcccaggtgatgctgatgctactggtccagggtccacacactgaagagtgaggcttcaaggctccccctcggggcatatactagcacatggggggccatcatttcctttctgtttcctcttcctcatctccatggctctctctcaatcctatcatctccaaggcctctccctcctcccccactcccagactgttccctgtccccaaacacctcgcctccagtccttcacttccatagcccccaactccagtatcttcagccccttccttctgcccaggctcctccactataactaaatctttgcccaggactttctgatctttcaggtagccagtatcatgtttcttctctgttttacaaaaaaaaaaaaaaaaaaaaaaaggtgaaaggtgatcctactcatggtccccaggcaggctggctacctcttcaaccttcatccctacaacctgtacaagttacttctgatggccaaatgtccaggctgtgcccaaacccaccccctccatcctctgcagcatctgctatggccaaccaactcctcctgctgcaaaagccttctcttgggccttacgcttttctcctacctgtctgtctgctttgccagttcctctcctcttctgattctttaatcatggtcagttcctgggcctcagcccctagcccttagccctctgttcttgtcccctttctccaggcctgctttcatccacctggcactctcatctgcaacctctcagaggaaggttccaaacatccacgtcctacctagactccacttctgcatttctaagttcccatgggatgcttttgcttgggagctccaccagcattctcactgcaatatatccagagtcatatgcatatgactcacatgaccatttctcaccccaagacgtctccatttccaggataatcaattctccctcccatctacttctgggtagctttgggggaatgacttagcttctcagagcaatttctttcccattaaatagggataatggtacctaccagactaggctattcggaggacttagtgggctaatgtatgtacagactacttggcatgtggtggtggtttcctattctcccctcctgtataaatgattaaatataccttacctgttcgatccctttaagtctagcaactggttcatctatcacaagtgcttggtggtagttgggatgggaagatggtgcttaagaggaaatgtaaccacctaaggtttctgtatagaaggcaggctatttgcagtggcatacaatatatgaccgtcatgggggccttggggttggtgaatataaaatgaatataattatggaaaccctgtgtcctatccagatgcttctgcatcccactgctggtatgagcttcctgctctgggacctgtggcacagaacttcatgtctgcaccaattgaaaggcctgtgtttatcattgcaccttcaactgcaagtatgtgcagatccatcctctgtcctttcacactgcttatcttggattccaccccagcacccagcacacagcactgtataaagtgggcattcaaagaccctgataggcaaactggctgatagagggatgggggttagatgccagaggtggtgatgggtccctgtatgcccacatctgctgtgaaacatgcataccctaagaggccctggaagaagagaggggctcccagggactactattcctgccatgaaccctgtggtttctgaaaggggaaataaagaaaactaatatttcatgagtgtcaactttgtgccaggcactttacaaaatcatctcatctcctcttcacagcaactctgtgagtcaggcaccattaccctcattttataattaagagaaaagagaatcaaaaagtttagaaaatttgcccaaggctctataaccagtgcacgatagaggcgggacatgagcccagagctgcgtcactcctgaagctcattctctttccaccatagcaatgacacaccatattgtttcgtacctccgtgtctttgcagatgcagtttcctctaatcagaattttaattttttcagtaatgggtaaagccatctctgaatacactgatacctatcccctgccacacaaaaaattcatcactcaactaagtgttcctgtactacagtatgtagaggcatctctcagctaacgtttctaataggtgacgttatgctagtctctcagataggcttgcatactgtgaggctgaacctctgggttctagccatttcttcatccacaccatatgaaacataatgtgcatgttcaaagcatgtttgtgggatgaatgaataagtgatctggtacttccagtattggtgatgggggcccatttgttcccatataacatgagggtggtagtacccgtcctaaagacctgtggaccccacactgagcagaggggatggggaggccttttgctggctccatctttatctatgaagccttcagcaggtaatgctattaggcacagcctctctcataaagctgagtttgccagaggtgagggaagacatggagcgctaagcaatacattttaccggaagccaggcattctctgttttaatcccactcttttgctagctggatgttcaatgaattcacatccttcaatctctttctaaggtccctacaacctctcaatttccaaaaatagaaagtgcatattaggaatgtggactagttcaggggctttctaactttttatcaccaaggatctactgtacagagttgttctcctttactatcatgttttgagcatctctgttgttgttgttatttattattattattattattattattttgagatggagttttgctcttgttgcccaggctggagcgcaatggtacgattttggctcactacaacctccgccctgggttcaagcaattctcctgcctcagcctcctaagtagcttggactacagacgcctgccatcacgcccagctcatttttgtatttttagtagagatggggtttcaccatgttggccaggctggtcttgaactcctgacctcaggtgatctgccctctcggcctccaaagtgctgggattataggcgtgagccaccgcacctggccctctgttttattaataagaaaaataatcacttttttttagcaagtgcaaaaaaatggataagcaagcacccatctataactcccaacaaaatgcactgataatatgagataaataatgctaaacaccaaacacataatcccaacccaaagcaaagacactggatgtttctttcacctgtgaggccggttctagataaagtaatgaatccctgcagactttctgaaatagcataaacagccaatgaatacctttctaaactttgagcccccagggctacccattctccaagtaaaaacacatggatttagaagttgctaagactgtgattctgtctcatgtgtgcaagtcctacagcaggatttggtcccctgcttgatggaattcagggattcctaactagaaaattacactcacaaaggagaaacagcccttcacatctctaaaaataagaggaaaaaaatccaagatggtggaaacataacgaacttgaacaatgacagtgcactttcaaatgtaacacatttatgcaaaataaaaactttaaggctacagacaacttagacagaagtgaaaatgagaaactaacagacacttggttggtgcaggaaatgcatgctacaggttcccttacagggcacgaagcaaagttaacaccagctcgatacttacaagtaataggagtaggaataagcatttcttctatatattgatgggcagtcagatgaaggaaatgtccaaaatgggggaaaaagaaaagacaaacaaacaagaattagatttttaatgaaatcttgattcttagaaatgcacatattatttcagcatccctaagctcaaggagatgcaagttcctctactaatcatcttcactgagaatcagatatttccagtggtagaagaaacaagagagacctcttctataatagggaaacccatggtctcacatagagtaagccatgtttcatgttggctgttgtagttggttcaaagttcttccttatggtcaaccaaaactagattccttgtaattatgatttttttttttttttttggtcggcggggtgcaggtgagggtattggatcagctctctgtggcttcctgggactagtctaccactcttccctatgataatgtcctgtgatctaagcaacaccaaacttcttctgtctcctctatttcagataaagtcacatcagagtctatttagtaaggtcatacccaaagcaaggaaatcatatagccagtacccaagatagctccccagtgatctgcacttcctagtattcaggcccttgtggactgccctcccacagagtcaggactgaccctgtgtgaatagaatgtggtaggaattatgttctgggactttccaagctggggaaaaaaaagaagcctctcagctctgtccataactctctcttagaaccctcagtctccatagaagaagcccagtttccctgaggctaccatgctggagagatcacaggagagcctctgagactacataaaaagaaagaaatgtcccaccagcccccagccattttactttcagccaaccaagttatctcagctgagaccattgacattgcggaacagaaataagtcattcccttcaagctctgcccaaagtgaagacacatgagaaaaataaataactgttgctctttaagccattagattttgggggtagtttgttacatggcagtagatgaccggcgcaaagtccaaccttatcttggaagagcactgtactgagagagaggagttccaaccttcagtctgaacagactctaccttgaataaactctctgttccttcatttctgcatctgtcccttaggtccattaaactagatcagtaattttccaactgtgttcacagaagtctgggggttctatagcagccactgtgtaatgaagaaggagggtactgagcaagtgaggctgctgccccccaccatccaccaaagcacctattttatatattgaagttttatctattttatactttgaagtttcatttaagatatcatatggctgagaattccattctccaaaagaaagcttcaaaaatcactggcttcaatctctttccaatgttcctactggctcctggcttctaagcaatcacaaaactcaaataaaagcatgatattccctttgttataacttttcttatgttgtaagaaaataaataggagtgttcttatttcacatcagattcagctatactgacaataaatgatacatttatagattgagaaaaatggctagataattcaggtctccaaatatccatctgagtagacaagaatggtttccttttttcttgaactatttgattacttgcaaccattatcccatttgcttggtacaggaaaatacagtcgttataactgcagagtgggggatacgtcttcacagccccaaattttcccatctcaagtaggaaatatccaaaactcccaagatggggctatctctagtctttctttcatcatctcatctcctcttcacagcaactctgtgagtcaggcaccattaccctcgttttataattaagagaaaagagaatcaaaaagtttagaaaatttgcccgaggctctataaccagtgcatgatagaggcgggacatgagcccagagctgcatcactcctaaagcaaagcccaaccctacacacccagaaggaaagtgagtctaaaagttaagaagccacagaagaaggaaagccccatacctccttagggggctgagctagggaaaatgagccacagtgcagcaagatctggccacatagaaaactgttcaatatcctggactgaaagaacagtgaccctagatgatgagaaggtgaaggactggggactgcaatgagtgggaattggaagctcctacagaaagtcatcaaatccccttcaccagccatacacgttagcactgtaaggagataatttctttacctcactgctggcaggtccagtgcctggaaggtgattcccctgggacacaaaactcagggtccatttgatgaagacttataggacacctgtgttctctgtattgtcaagaacactgagctgagaatcaagaggccagcattataatctcagatctttcaattgctcattgtgacatcttgggcaagtaagttcttcttcttccctttggacctctatttcctgatccatgcaccaaggtggatggcatagatgaccgacagctcaaacagctttcaggagtggaaatacaataagccttagcatctcagcaccatcacttaactaactgcatgaccttgaacaagtcactaaacagccctgagtcccagtttctctatctcaagcttggggacaataattatgtattcccaagaatcaccataggcattagcattatattaatctaaattatactcacattagatatgatatgtaatatataaagtattctatgtaaattccattaatctaaattgatattagattatattaatctaaacatctggaatgtattagggctcagtaaagggtggcttatgtctgcacctcatccacagagataaggtttactgcttcttattctggtcaccaggaacaaagtgttcacctctttaggaataataaaatatgaacaaatacttattcagcacttactgtgtgccaggtattgttctcagctttagcacacattaactcatgtattcctcacagttgctctaaaagataggaattagtgccattcccactattctgatggagacactgaggcaaacaagaagtaacttcagatcacacagctagtaactggatttgatagcaacatggctataaagcttgtagctcattttctttctttttttttttttttttttttttttgagacagagtctcactctgtcgcccaggctggagtgcagtggcgcgtgatctcggctcactgcaagctccacctcccgggtccacgccattctcctgcctcagcctcctgagtagctgggactacaggtgcccaccaccacgcctggctaattttttgtatttttagtagagacggggtttcactgtgttagccaggatggtctcgatctcctgacctcgtgatccatctgcctcagcctcccaaagtgctgggattacaggcatgaaccgccgtgcccagcccatagctcatgttcttgacctcaagcctgtgctgctttcaaggacagaagaaaatggatatatcttgagaaatctggggagtcaggcactgggatgtcaaaacgttatctctttcaatcctccccacaaccctgaggagcagatataattactctcacggttagctgaggaatctaagattataagtccatgcctcactaggtcaaaggctttgtgtatctttggaccagttgcaaggcctccatcctgagctggatgctctcactgtcagcagccacctcctcctcagctacactgagcattctggaccttctagtttttctgctgtcaaccttcaggattcacctcagcctgagccaagaaaacatgcttccttcttcaccttcaaaccacagaccaccttttccaagttgcttttctgagttatcctgggtgtcaccaaaagccttctcgtgctatctctgacccagcagcaaggcaactccaggataatggtaactgacaaacttctattaattgaatctcttttcccaattaaactgcaaagtcttctaggtcaagtatcacaggtctttattctgtgaccaaaacagtttacatgtgtgtttttctctaagccttgaagaagatttactgaaggtctaaatttacaaggatacagtgatattgcaagtaacagattgcctgaaaccaaaaatcctgagcaggaagacagctgtgcttagaaaaaacaaaacaaaacaaaacaataaccccaaacttaataaatcacatactgcagaaccttttttcagctagctcacaagattgacttcaggcacagttttcttttgttccatacaatttaaacaggacaaagttgtctatctaacgacccatttaaccacctacccatccatctagatcacaaacccacctgttcagccatctatccatccatccatccatgaacctatccatgcattcatgcatgcatgcatgcatgcatccatccatcccatccatccatccacccacccatcatccatttatccatctttccatcattaattcagcagaaacttctcaaaggcctactatatccttatctctgtcaagtacagatagaaagacatatgagatcctaatctagtccatatgtctgatgagagagccagactagcaaattataaagcagatgataatagctgtcacttaaatactgggagatcaatcatgtgtcaggtactgttttaagtatattgcatgaactattttatttaatcttcacaataaccttatgaggcattattatccctgtttacagatgagtaaagtgaggctcagagaggttaaggaactttctcacatttatatagttgttaagtggcatggcagggatttgaatccagggagtctgatttaaagagcctgtattaatagctattacattgtattatcttctgtcatgataaattgtatgataaggcaacacatggagctgtcagtccatacctggggataggagtgaggagggaaagcaggcaagatggcccaaaatctgggatgcctgagtggtaaagtaaaagagaagtcagatggaggagaggggaagggaatttttaggtagatggaactgtgtttgtggtttgggcaggtgggttaacaaagtgggaatggcaagatgttggaagggctagttcccaaagagtttaagcagcttggtctcagtcccataggtcacagggaaaacccaggaagtcatgtggccaaatatttcttgtaggtgaattatttttagcaggagggtgaggagaaagtcaaaggcagagtgaatgtggttacaccatcactgactggccaacacaagaaataccaggggcttcctttgcagtggccatgggatggggaagaaaggtcagcagtgtgcaaggtgtttaagacacaaaatcaaaaggtgattaaatgtgaatgtattgaagaagacttccaagttctcagcttaagtggctgtccacgtgagtgcaagcagaaggagcaggattcaattttcaggtgtagaggaaggagcagtttagaacaggatgaacagaagatgacacattttgtttgggcgtttgggcttttttcccacctcgataaatcactcaaaattatgccacagaatttggcatctcagcaggtcctgttttatatttaatccagattagatgatgtttcagagtgtggactccattatcagattgtccaagtttgagacccaactctgccatttattaggtatgtgattccaggtaatttccttaaactctatttccatttcagttttctgatctgtagtacccttaataaagtgcactgctcttttagcttggcctgagttagcttttctgattgtctacccagaaacaaaacaaaacaaaacaaaattttgtggcaatgtgctctctgaaggctcagaccatggcatgtcttccacatactgcctccagccttgccttgccaccctcctaccacaggacttggtgcacgaaccattaatgcttaatgttgacatttaggtctgttctctgagtgaagctctcttgtataatccatagagagttgatctgttctaattccactgggctctcccattcaacatgtttttaggaaattctcagtatttgcaaggcacactggagatgaagatgaatcagaatagacagctgatggtctagtgaggaaatgggatgcaaatacaaaggaaaagtataaggcagaaaataacatgggtcctcccagaggggatctagatggtgaagagattctgtccagatcaaaggtcaggaagggtttataggagaaagtgcctactgaattagtccttaaacatgggtaatagctggtcacatggagctgagaaacacaggcattgaagaagaagaaagttcgtaagcaaaacttatggagcagaggtgagactttaggagacttgtcagaaaaactaagaaaaaaatagaaaaactaaaaagctaagaagaactaagaaacttgtttccatatgggcagggagacagtatcacttgacaaagttccccaggtgacttagacatgtacttcttccctcacttccacctcatgaaccatggctatggagaagaagccattgaagggtttcagatgacaggtttgagagtacgagctttattttttaacacaatgctgactacagtatggaggataggttagaggggtggggcacagttaggaaggtcagtgaggaaactcatgcaatagggctatagaggtctgacccagggaaaagacaatggaggaagaggaggcagaggcagaggcagaaaggaagggagggagggagggagggagggggagaaagagagagagacagagagacagagacagagagacagagagagagagaatgagaccaagagaatgtagagaatcctgggtgttggaatcccatctgtttgttgatgggataggaggtagtgcctgtgaatgagatgggaaacaggttggggagtaggtaatgattttgactttgactacgaaatacctgagggattttcaaggtagatgtccaggggcagatgatatggataatggagctctaacaagagaagactgatcttcaggccagcaaaactacaaccaccgggtagtgtgataaatacacaaatgaagactagcatgtatggcacagtggctgcagaggaacatcactggatcttcctggggcaggaggctggtggaaaggctttgctgagatggtaacatttgggagtcctactaggaagaacaagaggctgagagtcagagtgtgataggaactttgtaggttaagagaaatctcaggacatttcattcagggaaacagcatgctcaaaagaagaaaatagcgaaattgggaaaaacaagccccagagaggaaagtggtaccgaatctgagtcacatgtttcttagtccaggatttgcttatttcctgtcagtctccatggactgacagagtagaaggtagcagcatgagctctagagacactgagactgggtttccacatcaactctgcccaaaacgttcaccaactcacgtgatcttttcgaacttcagtttcttcttttcaaacaagcaacagacctaacctactatgattattaggaatattaaaatcagagtatagctgcagtttaaatgaaaaatgatgcaaattatgtcagtgtgtgagcattgattgcaaccctgccattagcatattagtaacgggtttggagctggcctggtacagttgatggtcatgtggagatgaatgtttctgtagatattgtgcattgtaattccttaagcaggttcagggaacaaagcctatttcaataattagctcatttgatctttagaatagccccataaaactggctacctttcatagaagggaaagcaaaggctaagatttgttaagttgcttctgcaaggttgacagcaaataaacaggactaaaaatttggggccagtttttctgattctctgtcccattagactgagagctactggagggcaggtacaagtcacagagaattgatgtataaccagagatgcatataaaatatcagaatagacattcatatttatactcaagacactccaaatacactcttggaacagaagtttccatttggacagacaaggaaagtttggcaaaaggttaaggctggactaggacgagctgggcaggggagcaggggaggagacagggtctggctagaaccatggatggtaccaactttgaatatacctccctaaaatttcctagttctcatttgaaaattaaaatgtgatggacgggttagtgtaggatccaggcaagtccaggggtgcggatcttgtgaaaagtcctgcataacttggctttggtgtttccctatgcataagtgcatggccatgctttgagctttaagggaccatgttcagactccaggaagtgtgtcccaagggataaaatcgagctatatgaaacttgtgtgcgcatacatataatttcacgctccacaaacaaacattgaattgtagaccttctcatatgtgagtggctaatgaacactttcaactattgagacatgctggttaaggcaataatacttgatcttttcatcttaatttgcattaaaggcacacagtgccccatggtattaagttaagaaaacatagagttggtcatgcaacctcttgattgctggttttggaggagtggggaggatgtctaacagttctaaggggaggaggcaagggacgaagatgatcaggactgcagtgctgagtcagtgatgaaggtctttctcttatgtcaggacttaacatggtactcatgaaaaggaggtacattttactacataatgacatggggtacccattacagaacattcagaactctagatgtgatcgacagatccagaggaaaaagatggagccactatctagtgacagcagaaggatggatattgtgtagttggtgtggctaaaaccacactggtagttaactctgtcagtgaggggctccaggatcccttcttataatgctcatatcatcctgtttatgtccatgcaatcctaattccatatggttccacattcaatacagcccagttcaaacagccaaaggtaatgcaaaaagaattctaaactttaacttgcttctctttcaaactataagagaatcccatttaaatcacccaccaacatctcatatccctttctccttttcgtttctcaagatctccctccccccgttacaaaacaaaaccaggcaacaacaacaaaacacctctcaagttttgttgatattctctcttttccctcctctattttgtattcaggtgtctaaatataaattaatttagcttttttcattaaacccttcccttcatccatggatctcaagcccattctctgtctgtcttctagttctgtgtcataaaaggaaacccctaacaggaagagaaagactctctttggacagtggcaaggaagctctaaagtcagtgatcacaaaccttcagagggagaagctggggacatcttatgtttctggaaacatctgtggttatagctttaggggggctttgagtcagctgaatctattaggagcagaaaaaaaaccccggaaagtaaccatgtccatgaccagggaaggcagggagaagacccaggcaagcttaagccagtggaggggttgtagcagtgttggcctctgtgaacttctgagtccaagcactgtaggtgatgataggacactgaggagatgttaacactagtatcctgagctatggtgatgagcctgctacttggaagtttctttgacttgaatacatcttcctttgaggtagatgtagacagtattctggccaacagtaagttggtagcagactcaattgatcagtgtagtatatattgatatatatatgcagctggggggtagctggggacagaagaggtacacagaatttcgctttcctttggggcatctctagacacaggaagacattgtaggttagtggaaagagtgcaggcctatgttcaatttctctcttcctccccattttctcctcttctcctcctaccctcccctcccatctgtaaactgttccaatcaactaggccaacaaaatgtcttattttcttcaaaagatgccatatatgtaaacactgattagcaccccacaacatgcaatgcccaggttttgcctcctggggagaaatggtgatcatgtgatgcctgttgattgggtctgatggacagttttgatagacatgagagttgatgaagatactcagaggaggttaaaactaccacaaaggacttattttatagttgctcctaccctggaaacataaagccttttcctccctcccaaaaagtcacactcacacatttcagaaatagctgtgagaaggaagtgaaatttcttcacaatctcacagatgatggtgacgtgggttaagccaggctttagaaagagcaaaattggaagagcatatctgatttacaaatcagtggcaaagaataataaaatttcaggtctatcaaagaggtattcagttccattaatttgggtggacaatcccaaactcacctctgcctctaatatatctgtaactctaagaaacatttcacctctgcctctaatacatctgtaactctaagaaacatttcagtgatcttacatgtacaatgtgcttactgctcccagagaaatcaaaagtcatatactaccctatgtaatagcagcagactagtcactgggacatataatgtggccatgtgttatcagtgatgatggtgatatgacaatgtagtgttgaccttaaccctttgagggctattcacccccaatattaacataataccttctgttacccctagtttctccaaccagaaaatcagtagatggaggagaaccttagctcttaagccattgtgctgggagcttgaggcaagacatgatcctattagacagaaaaatgtcaagaagaaatgtcctcacagtttaatgccctggccagaggctagtatggttgatccaaagcagaaccaggagaaagagagagagggacatcctggggcttgcatagccaagagagggttgactgcatgtgtagtggggaccctagtatttctaaatcactgattgctggaaatggggatattgcttttaaaaaattcttcattttatattcatgtggttcctaaggtaggagctggaattagttgttaggggtattctgttcctttgttctggtaggaaacacatttgatgagcatttttcatcctatagatggaagcaagttcccagcccttgttcttggggttgccctgaactctgtgcataagcaaacccagagcttcaggctgaggtgttggtttggttaataatgtagaaggctcttttgcctgggagcagggcacaatacaccacctagtattataatgtggataaatgttttgtttgctatgatagactgaggagtgggaaggtagagactaaggttggggccctggcattgaaactgagaagacgtggaggtgggaagtagatgtgttaacatggtggcaggcaggggctaaggagaggggcgagtaagactctctgtttagaggaataaccagtgcaccctgtggacagggatagctgatattcaccctttgtattttcttccctctgtaatttccttgtgttatcctcaagccttgtgaatgcctcttaaacagaggatgctggtgtagtacatcttggaaataagggaggaatctgtgtgcatgctttcgtgagaaatgcaactggagaaaacacacagtatgagcaaactagtagctggccaaaggagtccagggagacatgcttttgagaggtgacaaacaacagcaacccagctgggaaggttctgtgggacaggacatagtacagagcctgtaataggacttgtaattgggaactctcacaccactgtagactctatctctcatggagagggcagcctgggatgctattatttgaccagtggaaatcaggggcaaacggaggtgagaatggtaaaacattactttcctgcaactgcgtttctggactgatccatgttcctggggctcccgagctatcttgatgacatgattgataacaacacagcagttaactcctataagactcaattcatgatacgtggaatcccatggcacatcgcggtggcccagtcatagggatcactggcccataagaaaatggccacctcaggaccacctgccaaacaggcagcatgcacccttcaaacagcaacacaatgaaccacagccggcccatgtatttccggacctcaatggttataacagaagatccctgctggacaatgatcaacagagcaaaaacctggccacacagcagtgttgaggtcacctcgggtcagcagagtcttgcaggcagcagcagagactcacctccttttgatggtgagcatcacgcccaggagaatgatgatgaacatgaggaggccagcgatcacgccagccatcttcacggtgttgtccacctgcttctctggctccacagtgttagaattctgggtggaggcacctaggaagggaaagggaaggatagcaatgttgaaagcacccaaacatgcgactagacaatcatcataatgacaacagcttcctttagttgagtgctaactatgtgccaggcactgtgctaagggcatcacatacattgtcccatttaataacttctgaggaccaattccttgtgaggttgggattatcattagattcttttgagatgaagaaactgacatgcagagaaattaagtgagttgccttaggttctcacttgggcaactgtgttgaagcattcttttccttaaggcaaatcaagttaagatttttttttctctcatattgctttgtctctaggatcaaaccatggaacactgggaattatacctaaccctacattattctttcaggtaaatggtggaaataacagctttattttggggcaacacaatttaaataactagatttttaaagataaaaagaggtttttgttttgttctttatagggaacaaatggtagggcaaaaagtttgtatattcaagggaacttgagtacaccttgggttcaaaaaaacacttaaatctgatcaattccatttttagcatttaatactaatgcaacatgctctaccaggtgttaacttgctgacacaatcctcagtagaggaggcaggtcactggccacttactatacatccttagccctatcctgggtaacttcatggatctggcctggtcagtcctcacaaacattcccaaaggtagacgagatactgattttcccattttatagatgagaaaaccaagggaagttgctaaaagtcacatggctgataaaggtcagggccagaattccacaggtttcctgattccaattttagacctcagtggtcagaaaccctgaatcccttcaagtcatctagttcctcaatcccttctccctaaaacaaccattctgcttatgccataacaaagtaagcaggcaaagaatgccaagaaccagtatcttcatgctacgtactagggatcagaggcaacatcttatttcagacattctagagagtagtccaggggttatcagcacccgaagtgaatttcctcctgcttctatttatattcctattggcgccagcctttaagtgggaagcagcttaaagtccaaaccatcctcttcctaactcattccttcttttcttccacatctacatcagctcactcttcatcagccaatacgctttctctgagcctgtgcccctgggagagtttctccctcttctctaaattctattaacactttataacactttgcacatgcctcacaatatcttttactacaatgcaccaatattattagttatttgttttcacatctgtctcctccagtggtctgcaaactcctcaggggcaagattacgcctcgtttatcttagttttcccatgttagcacagattctgactggtaatagggctccctaaatgtttgtggttgtttagtgtttagctaaaaggatgacgtctctgcccacacacatttgttctcatggaagcaaattgagttttctcctttttaaagtcatttattcatagaactcagcagagtcttgagttgaaggaatgctactacccaaaagctatggtcctgattcccaaaatgcactgatgtttaagccctccagcacattgatgcaccccctttttttttgcttaagagcattaagtgtttcctctctcagagcactttccccaagctgttgtaacttagacatgttgggtttacttggccaagtctctctagtgagaatggtaagtcaccctattcatctctctaatgccagtgtctagcacaggcctccctcctcatcattgctgcttaacagataaattataacataatatgagggtgagtgaaccacagttgtggactttatttatccattcaatcattcattattttgccattgagtggccatgtgctgtgtgctaaactatgctgtctgtagagtcagagattctgttcctagaaggacttctggatgaggaattttattcattcctttcacaagctaatggcaaaaccaactcatcaaattccagggctgactgagtagactcttctcatctacagcccagagaattcctgaaagagttggccaccatctcttcagcagggctggtctgacatttagggatggggggacgagggctggttctgaggagctcccatgcagcccccatttcccaggctggagacatgatttctgagatgtggctaatccacaatgtagcaagcataaaggaaggggagaatctcagatccaaatttcctcaatattgatagagtctttttatttagatttggaggaagggttgtctctggggcattcactcactggcacagcccaattttacttagtgtgcctgctaccaggtcctgttctagagactaggagtgcaatggcaaagagcccctagagaggatcctattactctaggaacaatgctattagcttggtctaatgagactcatacttcattccttcagtaagtgatcataaataccctctatgtgccaggcatttggtgatacagtggtgagcaaaacaggaacagttcctgctctcaaagagtctacaattagtggtggttgggggtaggggaatataattaataaatcaagaatcagtaatagcaaacttgaaccctgttaaggtttgaacagagaagcacatggcacttgtaaatagatacttgcataattaaaaaaaatgcattgcttcttggagcaattcacccctaataggggtgagttccaaaggaagacaggctgtaaccaggcaaagggaccatgaaagcagcatatgggagcagcaggagaaatagccttgcctaatggggcaagcaccctgttgtacttaaaaaacaaaaaaaagaaaagaaatgtagtataaccagggcaagaaagcaaggagggaaagatgaaaaagaagctgaagagggcatcatgaatgagtccacacaggatattactggccacaatgagggctgttgttctttaaccaaaggaagacagggcaccatttaagtgttattcaaggagcaatgatatggtcagatttgtatttccaatagatcattccagctttagtgtggaaccaaagtggattggtgaaatgagttttgagactactgcgggcattcagatgggagttgatagttgcttaggctcaggtgatgacagtgaagataggcagatgtgataaaagagacaattacttgaaatagttatagataaaatctgttgatggattggatatggggaataaaggagaaagaactgtcaaggatgaccacaaatctttgcacgatagggtggatggtggtaatgtttacgggttccagacacaatggaaaaagaatagctttagggggaaaatatatctagggcaactggagcttgagatatactccagcaaagtatgtagtcaaaaatgcgatctggagctctaaattaaaggtcagagttggaggcaaaaatgtgtgagtcatatgtacacagatggtatttgaagcgtgggggcctgttggtgaaatcaccctgggaaagaataaagagtggaaggagaaacagacctagaatagagacttgagggtctgcagtatttagtgagtagagggagataagcctgaatggggaacaggagtgaccagacaggtaggaagtaaacctgggagagtgtagtatcctagagccaagagaagagaatgtttcaaaaaggagggcatgatcaactatgccaaaggctgttcccagggtagaatcaagtccacacacaaaggaaagtgaagatcttggatgagtattagaaaaattttcccaaaagaattccaagacattcctaaatagaagcagcttcagcaacgaccataaacctacaaaagaacatacttgagggccacagaagaacattcaggggattcggagaggctgtctgaaagtccagagcctagaggtttagacgaattcaatgagttcagccaacaggcagcagagctgaaatcacagactttacacaggaggtttttagaaaaatccatgcttggttggtctaactagacatcagatacaggaacgtgaacattccctgggacagggaaaatccagctttgcctttggcactctttaggggaacttgccctagactctggatatttgtgcctctgttcatagtggaagtgtgttgacagggttcaaaggtgatacagggatagaggaaatggactaaaggcaagacagcatccacgtgtgactcccatatctgagggatggacagaggatgggagggtcccgcttttgtggcagagtcaggtgtggccacagggattacatcttaaatgctcagtggagcagaatgtgacctgtgatgggagtcataaaaaagcacatcagggttggctactgatggggccattggcaatgtggtgcgctttccacagatgccagcagtaggtccatatagaaggctatctgtctgactcagtggccccaaaatcgaaagggacttttcagagggctatcccactggaagcccttcagtgggataacacctgcgttacttttaccccaagcatatcctttccatgagagtcaggcttagtatcagccttagtccctaaaaggctgtctccgactctgggtgactttgttttattaagcagggcctggggatttgggaactgggagaaggaggagggatttgggtgcatcttcctcatctttaccctccagaggacccaatctgagaataggccaagcaaatcagaattggcatctaggcaggcaccagatgataaatttctccaattggggaagctttgaggctctacttgagtctcctgtgtgatgtgataaccaaaaataatcttgtgaactcagcttgtactgacaggagactccctctccaacatcatgctgcaagcctcacaagcctgacctgacggcacagccaactgtgtcctctgagctctgagcactcccaaaggctgaaccagttctcaaagcagctgctgctgcatcctgctgtctattctttccccaaatgccatgatggctaaggatccagtctcctcctagctccagcccagagtcttaatctggcttttatatgtgctacctgtctactcttacatatggaaacctggtgcacaaggcatggcccttggtttattaagctctacttccctccctcaatattagctccatacatagggtctagttgccatgttttctctctctgctgcctcctcccatgctacccagcaaccctcccagctgattttccccaaggattactgagacctaacaagggcagtgctgccctgctctactctgcactggtcagaatgctctggtgagtcctgtccagctgtgaacccaacctctcaacagggacctccagagtgaagacaggccatgagccttgctactcaaaaagtggtccatcgaccagaatattggcgaaacttgggagtctataaaaaatgcagtatcttgagccctaccccagacctactaactcagcagctgcattgtaacaaggtctctacatgattgaggtacacattgattgagatgcacaatgttccagagattattgactttgaaggtacatcactctgaatcaggatttttcatcttagggaagggaagattcagatgagacctattttttgcctttagatagataaagggccattgtggaaggtggagtagatttggtccctttaatttcaaagctcagagctgtatcactgggtagaagtgacagggggtagattaggaatcaacacaggaaacgtttgaatgtggaagagctaatcagctaaggctaaagcccagaccctttcaatgcggcatcatgttagagagaggatgaggtcattatggttccaaagtcctgcatcagagtcagcccttcattttacctgcttactctgtctctgttctcatctccttggcttcctggatgcacaactaagccctgaggacctcatgtctacaggatgctgacctttttctctgacgtcatcttttacctcaacttggttccccttaattccagtaatactcatactcttggtgagagaaattatccctattatctttagagccatgagactcccatgcagtccattcccaccccctcaccctgaccctccccatgttacccacaaaggcaggggaatgtgtcatcaacaaggacaagagctggctggaacatcctgtgctccccacaaagcagaagggacgacaagacttcttatgccccttttgatgtcgagatgctatggttttatgagtctagtcaaaagcattgggtttcacattggaaatatgcaagcttgcgtctagatgccatcactaatgggttgtgtgaccttgatcaaacctgttaaccgcaatgtgatttgatattctcatttatgaaataattagaaaatgccaagttcacactgggattttctaagaatcaaatgtaataatggagggaaaaatgcttgataaactcttgaggaactgttcacatatggggcacagtgatgatgtgaccttagcactggatccagggtagcactagggttttttgtgtctatgaactgtaggtcatagaggctgaggcaatgcctccttgtaacctgctacctaagttcatccgatcctcaggataaaggcagagcccctagagtgattcacttaactttcctcatataggcaaggcccatatcaggcttgcatctggatgacttaatggcagcaataacataatttggcaacaagggactggcaattaatgattaatgattcattctgaagtgctctcactggtgacaggcccaattctagagctttacttcagagaattttccttgtaaagatatggagcaaaaataggagtcacagataaagaacatttaattgcaattgataaaaccaagtaaatcccaatggatgcataacccatgctggtgatcattgctgacgataaagaaagcaacccggctctcagggacactattcctaaaaactgcactctttaaaacatacagttgtttctcagctatccaagggcatattatccccagtgtggcttatcagaggcaaatcttactttgctggcagtttaccccagtctactgaatggcttcttttgttgaagagtttctctggctttgtatgtatctggcacccagtagggaaaacctttgaaaccctgactctaagctggtacttctacgtcagggaaggttttaagcattacaggcatctctgattatgggggttttgccaagaggagataatagggaaaagatgaagatgctgggcaactttctggctcttctcaagtcaggtaagcaccataaaccttcttgattttgctggaaacaaattctcagaatagcagattatttttaagatggaattaaagtccaagacagaaaagaagttggcaggagagcatctggatacttcattagattcaagcctctagactttacaaattgcatcccaaggcattgagaatatttgtaattgtgatcatgaactactttggcagtctttgaggactgaaattgtagcaaacaggaggggtgcgagaagcctggggagaaacaaatgctgttgctgactttttttaaaaatgaaaaaaaaaatgtatttcagatactttacgctagtgtgatgttgatacaggaaaaaaaaatagactagatgattaaatcaggttccccccacccccacccttaccacttaaaaaaggaagaaataatcaccagaaaccagcacagcctcacatcagacagcattcaaccagggaaaaggaaaccactcctaacttttaaaacagagcaaatttactagaaaattagtacacagggattaggagacaatgctggggaaactcagagggtggtagtatcaggaagccactacccagcccagactggagaaacaaaaagagatggtggagttctcaaagcccagaagtaaggatcacccaacagaagtggaactctggtagacccatctggagacctgaagccatggagtcaccgccaaagaaggggcctgagcccaagagaaagaaggctcctcccttcctccagctttaccatctcttattaaagtctcccattagccaaatccagaagccagtaggcatgcgggtcccatgcaggggtcacctacatgcccaggagcatagggcaacagtaaaggatggttgtgacaccaaatgggccaaggacaagcatgggcttcttataaacaagtgatgctagcctcacctctctttgccactttcgaggggtgtgtgggcttgtaagtcagggagaatgtccagaactgcagcttgattttagccaagtcaaggccaacatggagaaactgtggctgactttcaggacagccgggtgtgaaactgagttcttccagaagatggaaacagaagggtcaagatatctgaccacatgcaaagtgctaacaatgaacaataaagaggtaacacatctagggcttttactacaatccaggctgccgttttaaacccttcacatatattctctcttttaatcttcactgccctatcactatggtttggatctgtgtctgcacccaaacctcatgtcaaaatgtaacctccagtgttggaggtggggcctggtaggaggtggttggatccctcatgaacggtttagcaccatcccctttggtactgtcctcatgacagtgagtgagttctcgtgagatctggtcatttaaaagtgtgtagcacctccccccacccccccccccccgcccactactctctcttgatcctgatcctgccatgtaagatgcctgctgcccctttgccttctgtcatgattggaagcttcctgaggcctccccagaagcagaagctgctatgcgtcctctacagcctacagaaccatgagccaatgaagcctcttttctttataaattacccagtcctgggtatttatagcaatgtgggaatgaactaatacacctatgaagcaggttccatcattatacctatttctgagatgtgggaacagcctctgagagactaagtaatggtagcaagcaggagagctgggacataggccctggcagtctagcacagagattattctctttaacctatcgtactactctgtcacctctctaataaatagggggagagaccgttcagcagagaaatgtgtttgtcttttctcaaatatctggaagaaagaagcagacacgtatttagatctagaatcttccattgaccagccagattaaaatatctttgtattgatgcctgtctctgccgggtttgccacccactctatcatgcagttctatttcatgcatctttcttgaagattatctcctctcatgccctcgcacccacgtatcctattctaatatctaagggattgatgaacatgtcatgtgaaccttgttacatgagccaaattatacagactttgctcaaatgatatttaaacttgacctttttaacttaagttccctcatccttttcacttttcttgtatatcaaccaccacctccaagcctttcatatgttgcagttagttttattataatcgctgggctttctatataatacctttattgatatttagcaaacaaaccatcccatataattccatagggagacaagtcttgttcaaatttaggtgatttttttctgctttgtctccaatattctttctttgatcttgctgtgactaatttttttaaattgctgactacctccccatgcctcaaagcaatgcctccttcaccagatctggttgataatagagcacttgagaaggattatttcatcattcttctaagtgacatcacctaggatgtttctcaagtaataaataaattgcctcaattcatcatatgacagtaattgcttttagtcacgatttaactcagagtcaatgttaagtagctggaaaataccacagagatgcagggttttcaaagatagctctacccttgctgtggaaaaccacttaataagtactgttaaatgcaaagaagatacacatttctaataccccagactcctcaatactacccagtcagtcctaagaagttagaattgacttcatcacagcctatacaactaaaactgctaaatattgctgacagaagttgccctcgttttcggcctcgaatggaggttagcaccctgtgagacaggaatagctttaattgattgtttgaaagcactcaggccactcaaataaattgttcctcaagtgctgattttgcttggtctcctgaatctatgcttccagatagaccttgttttacactgtaaatgctctgtgtaggtcaaattctagttcagtcatgttacacacaccaggaaagacggctaaatgagactctgatagagaacgtcttctggatgtaagaaaactcctttattctattaagaaagtgtcttttttttatccatggaaatagaggaaaacagacttatttatgagcagtcatgcccaactgatgccagacacagtcattattgacacaccccttctatggcatatccttttaaaggtttcaccgttggtgagctggaaatccatttatacctcccaatgacctcaactactttctgttgtgccaaggaggcctaacctatgagggctgccaagacccagctggggtagagagaggattcagtctgtggtaagactaagaccttaagctatgactagagtcaggtataaggttgtctaagaaaccaagtatagggcatactttgtagactgggttaggtttcagaccgcagtcaaggttaatgaccaggatgtggctgaggtaggggtcaaagctaaagcagagatcaggagtcaacttacggctcgggtttagaagtgttatggcagtcagtctgcatccatggtggggtcaaacttgcccacaagtgtggcttagactttattcagaaataaaatgtagcccatggccatgaaaataactggacaaagcccagtgacctccacatggactatatccattaccttggtctcattagcatcagttcaacccttggcttcataggaatagtcctggacattgcctaacctgagtggtgctaggattataatgatgacagtggctatagcaaggtgctgagcatggaaggtaattagacaacactactgtcttggaactcactacttagggggagaggaaagtgcaaactaaaaatcagagttgagtgatgggcaccaacacagaagtgtgcacaggaaagggcatgcccagctctgcttaaacaaaactagactacaaacttgatttccacgtcatccatggtgtgggacacatcagggcattcctgtgaccactcagtggccttctcttttccctccccaccttgactccctgtgggccagactgtcctgctgatgcggatgaagaggctgagtcatctcagtgctgacagtactggctccttgcttatagaatctgtgctttgagcctggagctcaggaggctcaaagccgcttagctgctgcaggcaggagcacccacggcctgcactggggattaagggtttagtctgaagaacagatgtaagaagaagaacataaactctttaggatgccctgcagcaaagtgatagtccctttagagttcttcaggcagccagtatgagagagctgtggtcacactgaactgactgtaattcttcctgtgaagctcagagcagtcccagggcagcaatgggccaaggagaggcttctcaggagcagccagtatagagccaagtacaaaagccaatcagggacagtctgcaggtcatgtaattccgggacactgagaacaggttaccacagcctggcttgtgaagcaaagcccaggccagggcatgaccagcaagcagatgctgagactattcaaagggagaagcagaaaccaaaccaagaaaggaaggtttagagccacagagtggagacctgtctgggccaaatgtagaatacagtcaacaaggggacctcactggggagatggggtgagccaaagggattctctggatggcagctcttggccaaggttttcttgaggtctgcccactttaaaggcacagcccttaaagctcaaccactgcccactggccagtgctcaggatcactgcatttctaagtacattcattttccagggctgttattacaaataaccacaacccaagaggtttaaggacagaaatttattccctcacaattctggaatccagcagtcccaaatcaaggtgacagcatggccatggtccttctgagactgtggcagaactcttctttgcttcttcctagcttctgctagtggttggcaatgcttggcattccttggcttatagatgcatcactccaatcactgcccctgttgtcaatgactttctccctatgagtctgtctttacatgatgtttttctcttcttgtaaggacaccgggcatattggattagtgtccacccttctgactttatctaaactaattacatttgcaaagatactgtttttaaataaggttccactcacaggtactggggttattacttcaacatatccttttggggaacacaattcaacttctaagaccaggtgaagctgagtcatgacccacacagcctggggatgggctacaagcaggagcgggagctcagcatttcactaaatgaaatgcaaactctaaaagggttcacagccaaatggacaggcagcatgtgggaagaggaatgggggctcctgcttggttgtggactgagcagaacacaaggcttctggaaggataatatgtctcagcttcctttgtctgaactgcatagcagggtgcaccagaggccgaggctcccctaggctcatactcagaaacataattcaattctttccaaccaactctggccaaattgatcccctaaggggtgactgtattacctgacttagaggggcaagaaaggggaggagaagcaaagatctgcccatctggggcagctttgtccagattatgcatctgcaacatgccgcttgcagctagcatcagagtgcctggaaaggagagaaggggcacgggaggaagcaggcaatctataggaaggattagtggaagcataagcaggatcagacagaggagccagtaaacacgcagcacagaatttcagattagtgcaactaacccgtgcaacggtaataaaatgagcagcagcaagcacggaattgattgttgagattccagccaaatccaccatgaacatgttttctttcttctagcctttgcccctttgcttttgaaagcagaaacactgaatcactgtgttctgtattaaaagctgatctgttcccctccccaaaggatggatggaaaagcagctctgctcttagtgggaggtgaggagggtagaagaagtggccagtgtggttgtagcagatgccacttgccacactggcacagagtcctaagacagggtcttccctatgactgcccacgattcctgcccccagcccaacctcttttgggccaacaccatgagatcccaggcgagacactgggctcagcaagaccagctccagcagatttgggggagctccaaacaagggctctgaagactcagtctctaggaagcttggcaggtgagtctgcatggagttcaaatactggattgaaaactagtgactcacaattagcccaacaaaatggtagatggtgagtagagtgaggtgcttgaaccatcacaggctggaggcagaagtggggatgggggtgagtataccatgcctggcacatgctccatcaatgtcagtcatctgcttatttattaaatcattcatgcatggggtcaaatgaatgagcactacaatgtgtgctaggcacagggaaagagttgatagaaaccaaacagctccaacaaaacatgcttataccttgtacatatgccatgttcaatagaaaactttgcttagggcgggggagggggttgcagttctttgtgccaagtggcccacccagttgactatctctgcatgcaatctggagataatgggggccagtaaaggttttgcagagatcaaactgtctgaacttgatcctagaggatgagtaaggcaaaccatagagggagaacatctcagcagagagaggagagtgtgagaaggcaagtaccactcacatgatcagtttgaacgggttacaggatgctgaggaggaaataaaattggagagataaaaaagggataggcactaggtggtaaatggcctttgattcaggctagttatcccaaagcacaaggggagccctgggagcattttaatcaggattagactctctctcttttttcttttcttttcttttttttgagactgggtcttgctttgtcacccagactggagtgcagtggcatgaacatggctcactttagcctcaacctcctgggctcaagcgatcttcccacctcagttagggccacaggcatgcgctgccatgcctggctttttttttttttttttttttttttttgagacggagtcttgctctgtcacccagggtgcagtgcagtggcatgatctcggctcgctgcaacctccacctcccggcttcaagtgattctcctgcctcagcctcctgagtacatggaattacaggtgcgtgccaccacacctggctaatttttgtatttttagtagagacggggtttcaccatgttggtcaggctggtctagaactcctgacctcatgatccgcccaccttggcctcccaaagggctgggattatagacatgagccactgcgccgggcctttttttttttttttaactttactttcgtagagacatggtctcactatattgcctaggctgatctcgaactcctgggctcaaacaattcactgactcagcctcccaaagtgctgggattatgggtgtggagccaccatacctggcctgaatcatactcttatttttagatgatcactctggcttcagtggggaataaatattggaaggggattgatgtaaagacatggggaccccaatttggaatctgtgacactaaccttatgagtcccagacatgagttgtagcagtgagcaagaaggagacagagattcaggagagatttcagaggccgtatctatcagatttagtgataaattggatactgaagatgaggaaaaagagaaggcaaggatgatgcttggcttctgaatctgagtttaatggcagtttgaatggaagactggagactgatttctccttgctttaaggagaatatcccaggagagaaaaaggtgcagtgagagcctcagtcatatatgctccctgattagacatttgttttgaagaagcacaaacattaacaatcatctcccacagaacaccctacagggatgtgacaaccctcttctgcattaagtcttttgattcagtggggagacgggcaacagaaaatggcagctcaaatgatgtaccaatagccttgtgtctgtcaagctttgagcatctgttctaagactgttgttaaggacagtatcctaatgcacttgatccaaggctcgtctcctcccccattctgtagtgtcagccttacagccatatgagtagttgcccagaacagctgaggagggtcctctgcaatgatcagcctggctcctggatgtcacctgccctcgtggcctccagctgtagctcttcccctagtcttctggcacagccatgacctttgtgcactccagaaccaaccaaagcactggtcaaggggaactagaggatgcccaggtcaaaggctcagggatgtccacatcctttcacctatctcagctctcagtcttgctcttgccttgggtcactgcaggagctggggttgctgtgctgctgtgcccagccatccaccttatatcctaaagctttgatgagccctgattcatgacttctatttggcactttaggtgccccaggcctgaggccctgatgggctcttacctatttcctccaccactcacgtttctcagaaaccacagttctggcccagtcaccagtcacagtctggcccagattcagtctgcctgaatcttaccaatggtcagcttgcctgctgctcactctctggacctcaatttcctcatctgtaagatgggttaagatcattataatgatggcacaagtctaagataatgaagttttttatctcatgattcttctcaataactggtcatttttagtatttccattttgcagatgagaaaatggggaaactttggggctcaaagcctctcagatagtaaattatgtggcttctgagactgtcctgaaccatcctgccatggtatttcccaatgctggctcagaatgggtgttctctaatgtctatgggcacagagcatggagagtatgattacagactgtcttgagagacctgggtttgaattctagtttcatcatttcagagttgagtgatttttaatcatctgaccctcagtttcctcatctgtaaactgtgactactaacagtactctatttggcagagttgctgggaagtttaaatgagttaatgatgtgaaactcagcacattccatagcatgtaggaagtatgtaacatacttgctgttatatttttcttttcatcgtcttattggacattcccaatgctttgtcccccagagctgccccctctctcctgacaggctgtgcccctgcctctgctgcctgtcttcgcctctctccatgaagcattttcccctcatggtggctgttcaggttggagcttcacccggttctcctgcctctggttcctgttctcacaccatctgtcaaccccttccactgggcacatgctcccttggagggtcactgaagcctcagggtgtccaagctcacagggcccagggcatgaccctagggagactgctgccttgcttcatcatcttctcttggcccacatagctttctcccaaaggctcaaactccttctgcctgggtctgagtaaagctgcccctgggaaagttgctttaaggacagttgctaagaactcccagagagtgtatgatgacctgaatcctgtcactgtgccaaggccgtgatttaaagaatttccagcgaaataataagagagagttttaacatgaggtacacaggaaataaaggaataataagggaagctgtatccaatatcttctcaaacctggagctgggttgagagtgcatccatttcttctgttgaccctcaccatgattaggcctggctgtacagggactcaactgtactatttcacaaatgaagaaggtgaggctcagaaaggcgaaaggctgagtaattggctcaaggtccccagttttaaggaatggagtttgggctccagatgagggcttgtcccacagctcttttttctgtagaaaattgacaatgggcatggggcatggccaagacaatgaagtcagatctgccactggggatgacctttagcacagctactctggcctccagactggacactgtcagtctcctcttgggctcagaagtccaggccacccccttgaggcctggctgaactgcaggagggatgtgaaaagaggccttctttctgcactggtgggcctggggaagactgagttctcttaatgttaattaactggtcacttctctactgcagcctccagtcagctcactgcagaaaagtgcccaatcctggccagaagaggattttaccttatttttctcaatataaacattcctgacctctacccactaggtgactatagcccctcgcacccagctgtgacaaccaaatacatctccagattttgccaaacgtcccctagtcctagagagcaacaaggaataaaaggaactgaatatttactgagcctcttctctacacatacatttctattcaccaactagggacaaagatgaccctagatgtgttacctcttgatctgcactgcccacaatggtagtcaccaagtcacgtacttagagcacttgaaaggtggctggtgtaactgaggaactgaatttaaaaatttattttattgaagtgttctatgtgtaaaatacacaccaaagacttagtacaaaaaaagaatgtaaaatatctttcatctgttgttttctttaattttgctgcatataataataataatattttggatataccagatgattgtgaacctaagataggtgggcttaagattctttgactttacaatgctgctgagaaagtaatacctgttcagcagagactacactttaagtaccagtgcaaacattctgcttttcactttcagtacagtattccataaattacatgagatactcaacactttaatataaaataggctttgtgttaaatgattttgcccaacttcaggctaatgtaagtgttttgagcatggcacatttaaagtaggctaggttaagctatgatgttccgtaggttaattgtattaagtgcattttcaacttacaacattttcaacttatggtacatttattgggacataaccccatcataagttgagaaggatccgtattgagttagatacattatattattaaaattagcttcacctgtttctttttacttttctcacgtgactctaagaaatttaaaattacatacaatattcaaattctatttctattaaacagtatggctctggaggtttataacagaggatgatttttgtctccatggcacatttgggaatgtctggagatgtacttggttgttacaattggggttgacgtgctgctggcatccagtggggagaggcagggttgttgctaagcatcctacagtgcacaggacagccccctgccaccggcccccaacaaagaactatctggccccagacatccatggtgctggggttgagcaatcttgccatagagaatgaattccttgaaggattagccaataaattaggaagacctgaagaactaattggacctagatgggcaaagaagttaaagcttttattgcacttagttctcatgattacctatgactgtggctattcatatttcaatttctccaaataaaaataatgaagtctggaaaagaaaaataaattatccaggatcaccagcccagaaggtggcattgctgagagctgaactcagcctccactcactccgaatgccagcctgtccctgctacataatgtggtcctgcagctctctgagttggtgctgatatgaaaagaggctcctgtgcttaaagtctaatatccccatcactcagacccaggcagttattatttacatcagccattattgctaccaggggacgaacattaacaaaaacaccctttgaaagggatggcactcacaggcacctcacccatcaaatgaggttgagaaacgtgtggaaataaatggatcacaatgaaataaacctgtcagaggaggaacattcagacgccttagaagacaagaggtaagaacaaaagcacctgatatgggactggctctgtttaaagaaaatattatctgactgctcgactggaatagagcctagagaacaatggcccagcagaaacggaacagctcgcacacactctggagaagtattgtttctctgtaaattggtggtgtgcacagtgacgagagtcacttttctcccactgtccatctgcaactcccacctccctttgggaagggcctctgataaggtagggctggggactgatttcagtaaagacctactatgtgctgcaactgcacacaacattcctagcattttctaatggaatttttaatatgactgcatgaagcacatatgataattagttttgcacgtgaaataaggctatgcaacttgcttaaggtaatctaacagggagtggctgagatgaaattcctgtggtgttggcagtgacacactggagtacaggtgtccatggcagtacaaaggcagagataaaacttgcccatagtggatgctgtttaggctcagccccaatctcctttactgggcgggtgtgactactctccagctgctgtgggtgctggcgcaaatggctcacaaatacctcccttcctagagaagtaccatcaggcataagggaaccacttccccaggaggtcatgcattcccatggcagcccacagccagtggctgaccaacaccatggtacaaatattggcccccttgcctcaaggtgggcccaactctttagtacatttcctactccagacctcccctttacccagggctcaggtagatgcagatctccacatccccccttagctttgttctctgccatatctcatcttcctccctttcttctgagaacactctgcaatgaataatttgcacaagaatctccatctcagtctcagtgtccagggaactcaacctaagacattcaccagcagtgatgtctctgagtttgggaaacagggtggcaggagtgaactgtgaaggtactggatgcccagactcatgtcatcacagcctgctgcacctccttctccaccatgataaactgaccgttcagggattagtagaccggaggccattgtctgggcaaggactttgagagaggtgacagttaaaggtttgaaatctccaagaaacttcccattgactaaaaagggaccctgtaataaagaggtctctaggtcagcagattatcttttgagccccacgatggacatcaacctctgacatgagtgggctctgtgtcctttgaagaatggcatacatttatgtgaaatgaactccacctatggtacacttgaggaaaggggctggtattcacttcaaacaaatacagactctggactgggcgtacccatggcagctccttcgatgtctattatcttgtttagtctcagaggcctctgcatgtgtacggtctacaacgtaaatggtgccccataaggggtaggtgggattattcctatttaacaggtaggaaaagtcaggctgatcatggtatgggtaaattgtcaggacaaatggtagacctgatcatagtgagagcttctcatttcctaagcacagaattgttatgtcaacttttttcccaaacttagatcacagctcagctgtcgcttcccctgtgaagcactcctttggctgcacatgggtttgtttattttgaataccatgtacctttcctttgtaacaccacttgaagtggcaaatttatttgtgtagtttttggaccagtggctgtttcttctcctggaaaggcactggaacatatcttcttttgctcatcattgtacatctccatgcctagaacagtgcctggcacccagtaggtacttagtaagcattagtagaaggaatgaataggtgagtggatagatgagtgtatgcatagagggatggagggatgggtggatgaatgaatgtgtgggttgatgggtgaatgggtgggggggtgggtgggtgggtggggtggaaagactgctgattcctctctggtgcacctggcctggaggacccactgagtgtgggcaactctcccctcccacccgcccagggctctggtgatcacctgtggtgaggaggcagagtggagtccccggggtcacctgggcgctgcccattggtgctgaccacaaggaagccagtccccaggcagcatgcagaagagaaggagagaaagaaacacacatgaaaacgtgcagcacggtgaacaaaactgcaattcttgtggctctgaagagctcacactaaatagcaaaagaacatcatgatttaacaaaacagggcctgaaatagatttaaaaaaaatgaaacaagagtaagaggcaccacttatcaagcacccacgacatgccaggtacttttctgggtgcctcacatataatgtttctaagatttagaataacccagaaaggtcagtatgactataaataaatctgtcatttttccaccgaaactacttctctgttagacttccctttctgcataaatggtgccaccatccatgtagcttctcagtctagacacatgggagccctccttttttctgatgtccctcttataatcaatcaccatgctttattaattctaccccagaaaagctcttgaagctgcttccttctctttaatttcattctcactttgttcaagccaaccttgtgtttcacatggattatttaagcagcctgtcgtctggtctctctgcctccagtcttgttccccttcagtcttactctccatccttcagttgaaatacaacagtgctgcctcgttgtccccaaggtaaacttcaaaccacctcactcagctcacaggccctccatgatgaatctcctgcccacccctctggtcttgtctctcttcactaccactgcccaccctgtcccaagcatgacaacagctttccattatcaacagccccccaccttcttgtatgtaagccttccttaggtgagtcactttgcatgggatatactccctcctgctccttcacctggctgataactgttcatccgtcaggtgtcagtttataacctgttacctctagggagtctttagtacgtcagtgaatctgggacagatgccccttcttgtcttcccataacaccctcatcttcccttcttattgcaatatatcactgtattagaaatggatgccttctcttaaatctgtagtctccttgaaagcagacacggtgtcccatttactagtgtactcatgtggccttgcattgtgcctgacacatagtaggtactcagtgaatatttgttgaataaatgaagaatgaatgaagaaatgttgaatcatagaatttgtaaaacttgttcaaggtcacaaactggtaaaggttgtattcaaaccctggtttgtctggctttaatgttcctgtcctttcaaatccacccctcacctctctaaagaaaaacatacaaaaggttgaaaggtgttttaggcttgtccagggactgcagctttctccagtgatccatcaacaaaactgcaggaagttcttatgcaaaattgagaagatagagtattccagaccaactgataaacaaaaaatacataatttcaaaaataatacagatggcaaacttgatcaacagccatgaaatactataaaatttaaccaccagtaaatagtaatcataatacttctcccttaaaaatatgaaaagttttgctgttttaaaagcacaatctaagtcaggggtcagcaaactatgacttgtaggccaaatctggccccccactccctgttttctgtgcagccatgagctataaatgctttttacatttttctaatggtggggaaaaaaatgaaagaggagtaatattttgtgacacatggaaattatataaaatgcaaatttcagtgtccataaacaaagttttattggaacacagctgcactcattcttatacatattcttatatgtatggttgctttggagctacaatgacaaactttagtatttgtgacagagaccataaggcctgcaaagctgaaaatatttactatctgtccttttacagaggagtttgctaactcctgttctaagtggctattttttagggttttttttttaaccccaatgctctcagataggcaagacaaagactgtcgccctcacatgtcagtaaaagaaatgcaaagcttcagagaagagatgacttacatgttcccacttggcccccttcagcagcctcttaactgctctcccattctgtagccttctccctgccttagtcttccttctctgattcattttctaaactataactagggtgtccttccccaaaaaggcagtctgcttaagtacctccaggggctccactatctaaggacaatgcttttatatgtgcgcgcatgcgtgcacacacacgtgcgcgcacacacacacacacacacacacacatacagtggggctacacagagtcctgggtggcccctgatcactcctaacctcatctggtcacactggcctactagccatcattcctttgccttgtcccatttaaattcagtggcatgctctcttgccttcagtgatttgcatacctactcccttggcttgaaggctttcttgacttactttgcaaccttgttcgacatgataattgttactcttctttcaaaccttatctcagtgatcacacattctgaaatagcataccctaagttgatttatgtctcccttcttgcccaccagtgacatcctgattttgccttgacgacagcccttattggacttatatttattcattgcctctcccatgaactactatttgctgagtgtttcttacaagccaggtattatattaagtactttcgatacattttctcatgaaattcttacattagccctgtgcagtaagtggtagtacttatttatttatttttgagatggagtttcactcttgttgcccaggctggagtgcaatggcatgatctcggctcactgcaacctccacctcctgggttcaagcgattctcctgcctcaacctcctgagtaactgggattacaggcatgcaccaccatgccaagctaattttgtatttttagtggagatggggtttcttcttgttggccaggctattctcgaactcctgtcctcaggtgatccacccgcctcagcctcccaaagtgctggaattataggcgtgagccaccgcacccagccataagtggtgttattgtcattggtttatagatggggaaacagagacacagaatagtttagtaccttttcctacctagaatcaaagaccatccaaatctaaagatgatgtttttaaccactagggaatgtgggattacatatcaatactaagttgtactcaataaatgcttactgaaaagtaaatgaatacatgaaagtctgattcagtatttttcactcactagctgtgtcatttggaaaattacatacatttctaaattttaatttctccacttataaagtggaggtaataattatctcatgaagtcatcttgaggatcaaatggaaaagagttaaagccttagttgggttggtgggcctagaggaggtacctccccactccatcctctaggtctgcaacccatgctgtgcttagcagtaatgctcagctatctggggtaggaacagagggacagctggataaatgcaggaatggggagagatttttctagttggtgggcagaatatagtgggatggatcatggatctcagcaaaacacaaaaggaggcagaaacagaaaaaggtcctgtttacatatatggttctagagatgtctcatgtttaccagtgtctgttccatctatccttgggcataggaaagagttccagtcaacttgcagttgggctgttgtcatgtgactagctctcatcaaggccatgtaagtggaagtggcatgagtcatttccgagtgacatatttaagatccaagttgccacttccatgctttctcttcccctgctcaggggttctctgagaccacatatattctagatggcacagcaacaaatatgcctttgtggtattaagctactgggagttgggtattagcttgttatgttagcaaagcctagcctagcctaactaatccagttgctgaggtagaggtctcttgctttctcctgcatcacctggtcccctgaccacatcacgttttgaggattcattacccttctctctttactgtttccaggccctgtacagtgtgtgtgtgtgtgtgtgtgtgtgtgtgtgtgtgtgtgtgtgtgtgtgtgtgtgttagcctgcaaagaaggagctcagaatgctgaatgtctcagacttcccttctgactcttgtcccttctaaagcaatcagtgttgagtgcagagagatgctgctgggctacagatggccctggagcagacaaccctgaagactaactaattttttggtttattagcttcaatatgttgtggaagtgaagaaagttgaggatttcttgagccacctcaccttctgctccaggacttagcttgaatactcctggagacaggccaaagaccatcacatgctaaatattctattatcaattattactagaaaagaggcatgggaagaggttaacaaataggtaggagacagagcatcctgtcagtggtcaatgaatctcatctgtctatagtattaacacaatggaatcagatctgatttccaattctgaggaaacttgagctccttatttaaccccttgagcccatttggcccatcattaagtaataacgatgaccactatttatttagtgtgtgctaagtgtcaggctttacttctgtcatcacactgaaaccttgtgtcagcacacaaagccctgtgactggcacacaataggtggttaatttttgcaaatcccttttaatccctcctcaaacatcacattgagatcccatcaatggggtttaaaatatccaatagagctttattctctttatttataacccttgtctctagcctaccccaaatgtgttccttcccggactcccaattttaaaaggccccccttttcctttagaagatgcaactgctttgcaataacagacttgcgatcaagtcgactcaggtgtctctcagatcttgagtagataattcttatttctagttgagaaagatggattggaactcccaaggtacatgcttgaatggcaagagttaatcctcacttgtttttctgaactctatcaaaccagcttttgtcttcctgagtggggtatggaagtggggtatggaaggggtgtgtgtggcgggggaagtttgagcacaactagagaggctagagagatgtgccagctgttgtagcaagaaaaatattaaagaaagagttgggatatttaaaggtcatatttaggctatcttatgtgtacttatgatatagttctcttcctccaacttcttgcaaaacctttaggaaaatctgtatttttccattgacattttaggacctagaagacagtcagtgagagcaaagggggccacaagtcaaggagaatttgttacactcatgtaactctgaggatcccagtcctggaaaatgtatctcatgggactcagctaaggaagaatagcattgtcctgcccaaaccctccagccacacagtctgagctttcacctccaaaagtttgacaagatttataaagactgaacaacaatcaagagctttccaatagactatctcactagagtctttcctctcacaagtgattccccattatggcccctaccctggttgctctagctagatttggacatgctatgctcctgggtccctcctgaaattgctggtctggtgatgaagaaaggacagtgtcatagtcaaggctagaaaagggatgaccacaatcctatacatgtccataaaagaatactattgctctgcaggatctcatctagagacaacaacctatcaatgggaaggtcaagtactgaaaagtgaggccaacatcactcctgtcccctctgggtttcttcactttggatctaacctgtatccatttgacaaacggctgatttgtagaactgtacaagcagtgactagagtctgggctgtggctttttccttagagaactgagagagaggatctgtgcttagtaggtctgggtctccaagtcccacattaaagactcagaaaggaagagagaaagaaggaaatatatatatatatatatatatatatatatatatatatatatatatatatatatatatatataatgttcttgaatacttggtagaaagggctaccgatctcaggcttcaaagtgaagggacagattcgtagattttaactgacttgtccaaggtctaacagctaaattttgggggacaggatttgaatccaggtgtttctaatttccaattattccatgcaacctctcaaggaagcttcctatataaaacagaatcttccacataggcttgtatcaatgggagtaggcattgcctattgatagcagaggattatcacaccacctgtggctgtgattctgtggataaacaaggcatggacacatcactcctcctctgggccccagtcttagcatctgttaaatgagagcatctcactgaaaaatggctatttagtgtccctgctggtccctgcaggagtgagaatccattatgggaaaaggagaggaaaatgccagatgaaatgctttatctcaggcttagctcttatgaaaagaaggcatatttacaaaagccagcgcccaaacctcttgctgtcactattggaacaatggcgttagtccatcgctgccaccaagcagaacaaaactactggtgacactggcccctcatcctatgcttcattattctggagttcagctttcagcacccactccaagggggttgttttaatgggatcgttagagagtgtttactagattaaaactgtggctgtcttctgcaaagcaactctgcaaatggctttatgggtttctgggtttattttgtctcaatgactcggctcagtttgcaaatcaaatcaaagctgatttttctaactgccactcgggcgcacccagcgggagtctgcagagccagctgtgttcccttgacggctggcgctggagacaagatgggagtgctgctgcctgctggcagccagagtggttccacccaatggaaagaagcaagcatgcaccttcctgaccctaaccaaggctggaggagcaggtcagaggaagcaaatttcattttctgaaaggagaaatggtagacagaatctatttgacttcaaggactgatgggcagaaaaataatagggagccagtttggactcataatgtagaagccctctcaaacggaagtgtccaaagtgtgaagcaagtccatggtgggtagagagatctctatcacagcaggaacagaaacagaggctggctggccttcttgttagtggggactgcagatcccatagtggacactttacctctgtcacttttactcctaccatttaagagaacaatcctgacatgtaacttgcatttgaaaaaaatgaagccatggaagaataatgacctgttagtcatccactcatccatccatccatccatccatccatccatccatccatccatccatttgttcatccaatgcatttcattgagtaccagtatatgctgagatctgggaataataaaacagtgctcaaaataagcacagtctttgcacttacgtcacttagagtctagcagggagatagacattaaacatgtaagtagactatatatatatatatatatatatatatatatatatatatatatatatatatatatatatatttgcaagttgtgatgagtgctatgaaggaaaagtacagggtttagtgagagtggaaaattagggatatacattaaaacagaggtcaggatggtcttctgaggacataaggtttaagaggccatcttaaagatacttctctgttaagatatttatctattaaggagacatatatagtagccaaagcatttcagagagagggcaagatgagcgaaggccccaagcttgggaggagtttgatgtgcctgaaaaactgaaagaagaccagtgtgccagagtgtaataagagaataaaaggatagaagcttagaggaggctggagggaggaagggatcagatcacgcaggcaagactggtggggcaaggcctgtgggtaaggaaaagtagcaaaatgaacagatgagtacaagaaaggagtcacggaagaattagaaagacaggacatcagtgggtaagagaacttggatggaactgggcatcagtttctcaaagggggactgaacaatatagttctagaattgaacaactaggtcagaaacaattttcccttggcctgctctgtctcagccagaggacatgaattgagatacctgggtacctcctttagcagctgcaacctggggcatcttctaccagatgggataatgtacctctcatgggaagggtcattttctctctacttgagcattagcacctctgaagtctaagtccctaccccaagcttccacatgctccattttctaaaggatcaccttaagcacctgtggctgacatcttcaacctgctacctatgttgagcccatccctcatcttccaaaggtatggttctaaatgattcccctgctcacttgccctttctaacatttcctattttaatgataagaacaaaacctgatttttaaattgctcttttttgctctgtggctttctattgtcttcctttcagagtctgaataatagttttaaatccaaaccatcacttaatgcctgtttacccactggctgcagttttctctctatggctctgatcagattgattcccaggtctagagtgtgtcaagcaaagtgctcaaaatgtcttttagcttttatattcaaggaaattcccttgctttttgctaccctaatcaaacatccttattggattaggtggtagtatcctcataaaaaggggaattttgaacacagtcaagcagacaaggagaatgtcatgtgatggtaaggcagtgatcagggtggcgcttccaaaagccaagaaatgccaaagatttgccagcaaaccaccagaagctaagagacacacgtagaaaagattcttcctcacaacactcagaaggaacaaggtctgcagacaccttgatttcagactttggacctccagaactgtgagacaataaatttgtgttatttaagccaaccaatttgtaggactttgttacagcagccacaggaaactaatagaggtccattactttgcaaccgtccaagctgggtggtactaaattagatccagagttactagtagcaacattacacaaaggaaagggttggagacacatgctggagccaggtgtgtgtctaatattcttgtgtaaggggtactaggcttggggtcaagttagaatgatcctgaatgagtgcttagggctgttacaactggcaaccatctggttctgtgggattcatgtagctggtcatagacagtggctggactctccagggtcagggaccagacagcggcaagttgcttcatcaccagagtactggccttgagtctgacatatggacttcagggtctggatgccctccatcagacccatgaagcagctgccgtgatgacagagagagggaagagccttgggagagactggtgacccatctctgggacttcatatgcttccaaagtccgtgggattctcagtatcttcctgtgttaaaaagaatactgttttcaggaaggctgcctagaggaaatttgatccgggtggtcaggaagggatgggataaacagaatattgattcccagctttaggttcttgatacaaactcctcacgggcagtggacggatttataatagatagggtttgcctttaatcaaccctaggtactctaagcatagtaccaggcaccaagtagacactcatcaaacacaggtctgcttccctttgtcctatgctccccaagcatccttcttatctgatgtggtgagaggggataactgaactgtgtccgactgacattctgcactatctagttctctaccccattcccaagtgctactggagcctcatttctttgggtttaagtgttggatctcaccaaattggaaaaccagaatgcggatgctctgatttcccaataccctgacctctcagaagcctgcctgggcttggacagctgggcattcacactcattcatgcattcctatcctttcacacacgcttactttacctgcatacacactccattcacttaaggaaagatggtaacctaaagctcaagcaagaggggaagcccttatgctaaggagaggtagagaactcttctgtctggttctttaaatgtcactgcaattctcttgcacatcagcaaagcaactctagagaagcccagcagggtgggcttctatgtctctgaggactgcagtcctgaagttttcaggagagtatagttttagagattcttccactgtccccatatgttcctattgcttgtcaggtctcatgtttccaattctcagttcagaaattatgacccagccagctaccctctaatagagcttacatcccagagggtgtccttagaatcccacctaccccatggagtgcaaatccattgcatccatctctcctggtctagaaatcgaaagccaccgaggagccatagagcataccatagtgaaggagctttctctgtgagtttccttccctctccagctgcttatttaagcaggctgcagacacctagctctcccgattgctgtctagagccctagtgctacccaattgatggtgttcttccttctacattatctgttttcttcagtggaaaagtctgccaatatctgtgatttgtgtcacttttgtttgcaggccatcaattctccttgcctcacagagagtattttatctctttccatccaggagcctgagttcctgagagggaacaagttagggacatgtcaccctctgtgactcatgtgaaatcatggtgacttcttatcacagggagccctagtgcttccgttttcttcttcctcctgcatcttctcttttgtgcctacatattgggctgattttcttcaaagttataaaagtcatgtgtgatgggtcttggtgcacatttcgtcaagtagctgtagatttttttctctctttttctccccactctgcccgtgtgtgtgtttatgttcctctgtgtggttttgtcgttgtgcatgtgtctatatatttacacacatacacatacatacttgggtcatcgcttttctctgtactttaaatctacggttatatgcctacttacgtttaccacttttatctccttggaagcagtctatgaaactatggatgctgccagtaaattcagggaacagagtagaattgcccagttctgttgtgtgtgtatggggagggtttgctgttaaaaatatcaactctgtaacaaaaagatacatctgatttctaactattcaaccctgtaataggttaaacgatagcaaaccattcattgattttgttttttaaaaagagtaataaacagaaacatgtaccaactgaaagagccaggcaattcaattacaattaggaaaacaaaagtgatgagcctgaacaatgctgccttagttttggggataagtgttgaaaatgccaaccacgtaataatgcagcgtttgtcttctcattactaaaggccccagtactaatcacctcatttttgaaagctgtgtaccaacagaacgaagtacagaactcagtagatgggtctaatagacatgcttaaaaaatacccacataaacatagacccaaatataagaaaaacatatatcaaaagaatatttgagtaaatttatatccatcactccactgatcaaagtaccagtccatccttttacaccattcatccacccatccatccattcagtaaatatgttttaaacttttactctattttacgcactgtgctactaatatacaccctagaatgtatgttctagatgcaaatgactccggtgaaaataacaattctttcttgttttgagttactgttgcctaatctttctctgtgtggctagaaagaaatacttaaatggctgaagaacaggtgaagacagacaagcagatgccaacataccttttgtagccagacgaacacagttgattttggtctcctgtgaacaacaaaaatgagatgccaattaattagctgtgagttatataaaattgttatataaagacaaaaatacatatatatttgcatatatattcatgcatatgtatttttaattataattttaaatttgccctttccatttttttccccatcggatgaccttttaattccattttttaatttttttctcaggctaggtacatatgttattcagttcacttcctgactcctaccatctcataaacctcattcccagacagaaccactttataaacatatcagataattcccagcactcatcatctttaacaataacacgtagtgggtacttggggtatgcaatgtgctttgttcagttgcatgagtgagcagatggaaggagggcatccttgggaaactttgttactagcaataatgcatctacatgcatagacgggaagagatacttggcaatagtccagtctatatgaaacatgtcaaactcaaactgcaaagttcatgttcaaaagttacttttcccctgagctcttgtgtgggcctcgcaaccttcataaataatgtgtgtggcaatagaatctttgctaggtgaactatctagttgttgttagctgttgccaaagtaaaaaggattcataaatgtgtgatgttgctgggcacacagtggagttaatgaagagtgtgcttaggaagagaattctctgcccgctttactgggattcatctcccaggaggtcctggaaccagctgaaaattccagttgactaaattatacccccaacaacagtctgaattcagtgtagcaaggaaagtaaaatgcaaagaatgcaagtatgtgagttgctgaaccaaaaatctgtcaatcatccaattcttgtcttgctgcagctcattcacaaagaaccattgcatcttgaagggattggtggcaatcaggataggaaaggttaggaggccataataaaacccctgaacttcagtggctaaaaacagcaaaggtttattttccattcaaactacctgtccaatgtaggtgtgtggctgggtctaaggggtgagattgggggtgattgggagacactctgaccattgtaaccactcagagatcatagctggtatgtccattttaacccaaggggagagagtgctaaagggtaaagcagtatcaatcaaatgctttgaatcagaagcgacactttcacttctatgcgtgctttattggctagaaccagacacatggccatgcctaattttagtgagatggggaaatggaatcctcccatgtatccagaagtagagaagacatgacaatgtctacggcagattctattccatctaggtacacctctgaatgctggaaatgatcacttctattacgtccaagtatgactccccataattaatctcatagttatcgccaatagtcttgattcttttcctcaaaatgcacagaaagtctgcttttgcttgtgtaaaaaagaggtctggataatgaaagatggttctcgggctcataaacattcttctttatcaattcctcatattataagagttcaagtcttttgagctatcctagctgctcattctaggacaaactccactttatcctattaatgtggggtgactagaacacaaaacagcagtctatacatgctcttattgatacatgattatattgatatatgattatctagactatcactattatccttacttatattgggcttctattaacatagctaacatcctggtgtttatccgtctcccccaaccaaaaataaaagtattggttagaagcctgcttctacatgtacaagtgtggctatatttttgaaacccaagtacagagtcatatttaccactacaatttccatcttcttcaactgatccaagtactacaggccatcatcacagtctccacaagctgaaaatttttagaaatcatttttttctttaatttcatccagatcattaatataagtaacaatctggataatgccaatggtagaaccttatgacatgtactagattccttcttccacgttgatattcatctgttaatcagaatcagaactaattgctaatatcctaaactgcttatgaattgagcttgagaataggttcaaattccttttagacactgatactctgtctattgcatttctccaatcagtgcaaagactgtcttaaagaaagaaggttgggttgacatgacttgttcttcggaacaagtgttttcttcttcataaaaactataagtgtctctctttaaaacaaacaattatttcattttataaagtagataatttggaaatgttaaaaaaatgacaagtcatggttcaagtatatgaatcattcatataaaatcttcacacaaaatttgaagcatgttacatttcaataacaaagttttttcagagaacatacccaaaagatgaaaaaaaaaaaaaggaaaatggctgagaaaaaaagtaacagtaaaggacattgctctaaatgtgatgtacaaaaagcttaagttacaagttaaatcttgcatatgacaattaaagtgagcaaactcatttctgttttcatgtttggacaaaggttttcagcttctgttggcttccattccaatagcaccataccctgtgttttggtttaaagagcttgagacggttaaataaagcatgaaacccagaacactgaagaagacatgcaaatgattgtacagtgtcacaatgactatcattgagaaattgtgtagactgggagaggtgccaggagactatagatggttagaatgatcttccacttcatggtaatgcaacaacaacaaaaaaagattttgaaagtaatatattagaaaacttgccagttctgtgcatgatttttgaatagagcagagggcaaaggtttgatgaggctaatactgctgagagtaatttctaaatatgtatcttcactttaaagaaattcagtcttatctgtccagacatctaagaatcttttctcagggaataactttaaatataaatgaagctttatattcaatgatgttggttccagtgttctttataaaagtgaaaatcatgagcgatatatctgtctaaccacacaggcatggcaaagaaagctgtggtctctcttattcaacacagcactgcaagtcctagccagagcaactgggcaagagaaaaatttaagggcatccaaattggaaaaaaaaaagtcaaactgtctctgtctgcacatgacatgatcttatgtatacgaaaaaccaaaaactttaccaaaaaaacactcctagaactgctaagcaaattcagtaaagttgcagaatacaaaatcaacatacaaaaatcagtaatgtttctatacatgaataaactacctaaaaaatacaaaaatcagtactgtttctatacatgaacaataaactacctaaaaaagaaatcaataaggcaatctcatttataataactaccaaaagtaataaaatacctagaaatcaatttaaccaaggaggtaaaagacctctacaagaaaaaccaaaaatactgttgaaagaaattgaagggaaacaaatagaaagatatctcatggtcatggattggaagaattaatattggtaaaataatcagactctccaaagcaatctatagattgaatgtaatctctatcaaaataccaatggcattcattatagaaatagaaagaagtcctaaaatttgtatgaaaactcaaaagaccgcaaatagccaaaacagtcctgagcaaaaagaacaaagctagaggtttcacactaacagactttaaaatatactacaaagctgtaataacaaaaacagcatggtactggcataaaaacagacacataaaccaatgaaataatatttttaaaaacgccaaaattaatgcacatatctacagtcaactgatttttgataaagtcaccaagaacactcactggggaaaggacagtgtcttcaataagtggtgctaagaaaatggatcatccatattcagaagaacgaaactagaccgccacctctcaccctatacaaaaatcaactcaaaatggataagagacataaatgtaaaacttgaaactataaaactactagaagaaaacataagggaaatggtctgaaaccaaacatatgacactgatctaggaaaatattttatgaataagaccttaaacatataggcaaagaaagcaaaaataaacaagtgggattatataaaactaaaaaattatgtacagaaaagtaaacaataaacagagtacaaaggcaacctacaaaatggaaggaaagtatctgcaaactattcatccctcagggaattaatattcacaacatactaggaactcaaacaattcaacagcaaataaaaatccaactaaaaaaatgggcaaatgatcttaacaggcatttctcaaaaggagatatacaaatggccaacaaatatataaaaaatgctcaatatcactaatcatcagggacatgccaattaaaactacaatgaggtatcatctcacccttgttaagatggctattacaaaaaaaataacaaatgctgctgaggatgtgcagaaaagggaactcttatacattgttgatgggaatgtaaactagttcagccactatggagaacagtacagaggttcctcaaaaaaactataaatagaactattatatgatccagcaatcttactactgggcatttatccaaaggaagataaatcaatatattgaggagacatctgcatcatgcttattgcaacactattcacaatagccatgacaggcaatcaaactaggtgtccaaaaccagatgaataaagaaaatgtggtatatatacaacaaggagtactattcagccataaaaagaataaaatccagtcatttgtggcaacataaatggaactagaggacattacattaaggaaaataagcagtaaacagaaagttaaatacttcatgttctcactcatatgcagaaactaaaataagttgatctcatagaggtaaaaagcaggaagcagatactagaggttaggaagtggagagagagaaagggaaagatttgttgaaggatacaagattatacctagatagaaggaataagttctagtgttctgtagccctgtaggatgactatagttaagcaaaatatatagtttcaaatagctagacagaggatactgaatgttcccaacacaaagaaatggtaaatattcaaaatgatgaatatgctaattaccttgatctgatcactattcattatatgtctcaaaacatcactatgtatcccataaatatttacaattagtatacgttaaaaacataaaaagaaaaaattccaaaaggaaaactggggtctatctacatagtagaatattatggagctgttaacaaaaatgattgtgagggccatgtaataacatgggatgatacacataagagaatattaaataaataaagcaaagtacatttttttgttacaacatgcaaatttaagcatttaaaaaatacatcctgaaggaaacagactaaatcttaataattcttgcacaattaatttgaagtgcaatatacatgcagatgagtatactaaacttaaatacagtttgacaaatttttcaccaagtaaacacacacctatgaccagcacccagatcaaaacactcaacattgccagcacctcagaagtttccctcatgcttcttctggtcacttcttctctgcaaatgtgaacattaatttgctttctgtgggaatattctcttaaaatgtggtcacaataaagggaattctgcagagtttttttgttttgttttgttttgttttgttttaagattcagagggttggtgtgcaggtttgttacatgaatatattatggaatgctgaggttagggcttctattgaacccatcacccaaagagtgaacaaatgaacatagtacccaatatgtagtttttcagcccttgcctctctccctctttccccacttgtggagtccccaatgtctattgtttccatctttatgtccatgtgtacccaatgtttagctctcacttacaagacagaacatgtggcatttgattttctctttctgcactaattttcttaggataatggcttccaggtacatccatgttgctgcagaggacatggttttattcttttttatggctgcatagtattccatggagtatatgaaccatgttttctttatccaacccaccactaacgggcacctaggttgattccatgtctttgctattgtgaatagttctgtgatagacatacaagtgcatgtctccttttgttagaatggttacttttcttttgggtatgtacccagtaatgggatttctgggtcaaatggtggttatgtttttagttctttaagaagtctccaaactgctttccacagggacagaagtaaagccacacacctacaaccaactgatcttcaacaaagatgaaaaaaataaacaatggagaaaggacacccgattcaaaaaacgatgctgggaaaaccaggtaaccatatgcagaagaatgaaactggatcactacctctcaccatataaaaattaattcaaaatggattaaagacttaaatgtaagacctcaaactataaaaatcctagaagaaaacctacgaaatactctcctgggcattggcctaagcaaataatttatgactgagacctcaaaagcaaatgcaacacaaacgaaaattgactattggaacctaattaactgaagagcttctgcacagcaaaagaaaaacaaaaacaaaactatcaacagagtaaacctacagaataggagaaaatatttgtaaactatgcatctgacagtggactagtatccagaatctgtaagaaactttaacaaatcagcaagaaaaaaaaacaaatagccccattaaaaagtgggcaaaggacacaaacagacatttctcaaaagaagacgtataagtggccaacaaacatgaaaaaatgctcagcattgttaatcatcggagaaatgcaaatcaaaacaagatactgtctcataccagtcagaatggctattattaaaaagtcaaaaaaataacagatgttggcaaggttgcagagaaaggggaatactctgttgatgatattgtaaattagtgcagtggtttattctatcttctcttgtacattgtgtcatttgtgagaagtttttaactttccttaatcttcccttccacagtttcgtgcaggaaaatgagccatttcctaaaatcaccccttcagcaccacacgttttaaagtctgttttctatgatctagagtgtatatacgattatgcttaagtcttcctgactgacaaacgtgatgccaaaacgtttgttttctcctaagttcctaacaactttaattccataaccaatttgtctctgttggtcagaattaggtacagaataacaaagccctaagtcactctcttgaccttctgagtgactagattgtcagcaagcaaatcaggtatattctggatactctgatatttatcagaggagaggtgtggccagtgtgcctatgtccaaagtgcccagtcttttcaacaaaaagaaatgagcactttctttgttctcggattatataagtctctggggaatggaaaaaaaagctgtattttctatttgatctctactataccctaattccaggtttgtaatatattctgggacagtacaatataatttcatttccttatcattttaatctcacccatgctccacttcccactccagattaaaatctgcatgcaggtataaatcaccctggggtagaacaccgtgtccttactgttgtgctctgttgagaaatgcttctactcaaggctcggccagtgcagcaatattgggtaactctctgtccctttctgtggctcaatttccccatcaatcaaatgatggagaatggggtagaaaaggccactttggtagaataggcaggccactctaccaaggttgcttccagtcctcaatgctgcgtctggttttagctactggcagtactcctttactttcagtactcagtcttcttgatactacttcctaatacctcatttcatgcaaataattttatttatttatttatttatttattttggtaggctgttacctaccttattactcaaaatgcctcatatctgtatctacttatagcctccattttaacactaggtcaagtctgactcatctaaccatccatccatccatccttcaattatttactgaaattttaggatgcctcttcaattgaggagttcacagtggaactgtttaggtcatcaaatgtctcatagctgctgtttatcatccagaaagacttgggttaggctgctaacctgatcaagaagccctaggtacctggctaatacatacaattcttactttactgctctattagactcctcatttaataggatgtagatttaaccctgatcccatagttttcaaatagttttcacattatcccaacttgtgtctttattttgtctaagactgagcttcccagttgatatgatggaatttagacctgacctcagcgtctttccatagtttccccagtaactttgactcaggccttaattctcctctaagactgtgctgagatcctgaaagtctacctaatttttgttcatgtactcatttggtcaactgctcaacagatatttattgaatgattactatgtgccacacattgggctaggtactggagctacaaatacgaccaaagtagacatggtccctgtcctcatagagcatgcagacctggggagagacaaacattagacaaccattctcacaaacaagtatctaattaaaagttgcaataaacactgggagatatgcaataaacacacataggtatgtatttacttggtgaaaaatttgtcaatctatatttaagtttagtacagtaaactaaatgaggttgtgtttaaaagtttagtacactaaagtaagtgagaagtgccaggtgctgtgcatgtgtaagggagatggcatggggtgtgggtgggaagggagatggtctgctgcttttagaaagaccatttaaccttagaagttagacacaggaagcatcaggaaggtcatcccagactcagacacagacatgcaaaggcctgaaagtgggaaaatgcatggtgctgttgaagacatacaaaattctggcatggctatcatcataatgaattacctgaggcatgatgtaaaacgaagctagcgacataagaccaggagaccttttgggactatagagttttggtctatattttaagaacaacaggaagtcattaaagagctatttaggcaggaagaattgaaatttcaggtttaaaatttttaaaggtagaggctgttacatagagaatagacttacggtgcaagagaaacaagttggtgagaagaaggtggtggtatagtcgaatgatgagatggtggtgccttagaccagaagagtggctgcagtgatcctacctcaacctttccctacctttggaaagcatatttttgctctgtttgactctagagctccctcccaccatcccaccccacctcacgcatacggatcagcctgggcttatggtattgacagcgttgggtccttagtctagccttcccacaaactgactctccttgactttcttccattgcactgacccttaagctattgtttagccccaatgggactcactcacttaacatgtttgttacctgaaagaagcactaagaatttttttttttttttaaaagatgtcctcttttcttttttctttttgaaacagagttttgctctttttgcccaggctggagtgcaatggctcaatcttggctcattgcaacctctgcctcttgggttccagtgattctcttgtctcatacctacttagcatagtttatgtcttttaatccttataacaagactgtgaggtggatacgacaatgtccatttttttctcacaagattaaataacatttttcaaggttacacgtataataagccaggctaaaatacaaagtaaacttcaagcaagtggccttcttttctgaggtgtctgtaaggcaaatacccctttgtcattgaggtcagatgctatgctttcttgggttgcaggcaggcacacaaagacaatggggcacagctttctttggaaaacaggctaagtggtttgtgatattacaaaattctgtttgacttgacgcaggaccttgaacaatcagataagatctggaatccttgagtaactcagaaccattaggactacgtaatgtggtagcctcctcctcaaaggataatgcatgaggaatgcctttaaaggggtaacagaagcagtggggcacttgagtgctagctcactagaaagcacgtatgctggattctgcagaccctcagtaaccaacagtgagtggcaaggtgcagcctcaggttgcaggataggtggctattggttacagacacttctaactggacaaatgttcactatcaactttatgagatcttcctggaaggcattaggctccacttgaggcaatagccaaggccatgagccatactctaagaaaggaagcccccaagtagcatgcaagccattcggaaaatttaaaatcaaacccaacctctgaaaatcttcttgtaagttttatctctacttgctgactccattgcctcaactctccaagtctctggaactcccttcagtgagactacactaagtccactaagacttttatatggtcagcactcatagtcactgctacaactccatcttccttaatctctcatcaacattagctgcaactgaccattccctccttgacctgtttaattatcttggctttaagtcattctaccttccagacttttctcctacttcactacctgttctttatccctttctttgcctatgtatttatcctttacttgacttcaacacactggagtgacctggagcttggttttatatcctctttcatcatttgtatcctaacttttttaggagattataataaattgcaaggatttgaatattatgttctcatgactcccaaagtactttttctagcattgatattcctgagatccaggctcatctatccatctgtctacctgaaatactcacaatcaaatatacaatcatctaaaagaattgttttctcttttattttcactccaagccttactcaccactaattttccatgtttaaataaatgtcaccatcatctacttagttgattaagcaaacaacctaggagtcattattgatttttctagatatgtgacttcccacagtcaatcaaccattaattcatgttggatctgggtagttgaagaaattggtaactatttaacaccaaattttcccacatatgattcaaaaacaacacaggaaaagaagaaaaaaataaaattgtacaaaatccacaatttcagcataattaatgtatagagaagtcttaaaatgtcataggcctgtttggtacaaaaagaagaaccagatataaatgaaatatctctaaagctttcaacacaatcacccttgtcatcctatgtggagaacaagagctatgtaaaaacaatttggaagagaaaagaggtaagctagcagagagtacatggctgatctaaaatacgttccagaaagacaaagaccacactacacatgaaagtgctaaaacaattcctggtagatcaaaactaagagtacaggaaaaggacttgaaagaacatgtgactcaaggtggtagtgttcaacaggtgaaataggttcaatgggtgaaaatgagataaaaagaagggagaagtactcttggaagattggagattgaaggaaaaaaggaagcaaagtgggaatttttagaatcacaaaagctagaataaaaacaaaaagtcagaacctacacccattccctatgacatacacacaaaatcatcgactgaaaaaaatacctgtactttactatccagtcagaacaaactgtttctgaactgagaatcgtataagccactttaaatctaaaaaattttttaaaatttgaaagagcctaataaagctactagatgaagaaaacagaaaatgtcaaaacaccacaaatgatgaaaatctacccctaacaagaaaacagtctagaagtaatattacaaactgaattaaatatcctcaaacaactttgacttacagaagcacaagtgaaaaaccaaaatatacaaaagatcaggaaaaaataaaaagaaagttgatttaactcaggagagaaatttttaaaagatcacctcagaaatgaagattaaattaccagatgtcaaaaacagcaatttaataaggggcactaaagaaagacagaaacccaacaaagacaacagaaatgagatatagaaaaaattaacaaggattggtgaaaaagtggtttaaaagtaaggcaaagaaaatccaacatatatatagtgaaatttctgagcagagagacaaaataggtaggtaaatattttatgacaataacccaagaaaaattattggaagtaaaagaagtcccaagcctctatactgaaagagtgcacagtaccctggggaaaatgcacctgaaaagatcaactccaagacacagcctagtaaactattaaacttagaataaatactctcaaagccaaagagattgaataatgtacacatgcaagagaattagactatcatgatacttctcaaaaacagcatgcaaagcaagaaaacaatgtggcagcattttccaaaagctcagagaaagtattaatattaaccaaggacttcatagctagccatgtgtttttcatatagcaaagctatggaaaagtagctttcaacattcaaaaagccagggcatgctgtacttgtctttcttgaaggatctacagaagataagttcatccaaaaaatacgactgaggaaacttcagcaaaaggactgatgggtaaaagtttaatatgtttaactgtaaatctaagactgaaataaggtaggggttggatgaaagtaggatatataaatgttatgttttctgtcattgcagaaataatacaactaaaaattgagagagagagagagagaaagaggaagaaatagggaaagagaagagtagtattaggtcatttattgttgtacaggcagtgctatggtctggctttgtgtctccacccaaatctcatcttgaattgtaatccccatgtgttgggggagggaccttgtgggaggtgattggatcataggggtggttcccacatgctattcttgtcatagtgagttttcatgagatcagatggttttataaggggctctagttcctttgcttcgcacgtctctcttctgccaccttgtgaaggacatgtttgcttctccttccgccatgactgtaagtttcctgaggcctccccagccatgtggaactgtgagtcaaacaaatatcttttctttataaattacccagtctcaggtaatatctttatagcagtgtgagaacgaactaatataggcaatatgtgaaagttaatggataccagaaaaatctgacaaaccagatagcaaaagattaaacaagaaaagatgggattaagagtgctaaataggccaggtgccctggcttacgcctgtaatcccagcactttgggaggctgaggcaagcaaatcatgaggtcaggagttcgagaccagcccgaccaacacagtgaaaccccgtctttactaaaaatacaaatataagctgggtgtggtggcacgtgcctgtaatcccagctactcaggaagctaaggcaggagaattgcttgaacctgggaggcacggtttgcagtgagctgagatcacaccactgcactccagcctgggtaacacagcgagactctgtctcaaaaaaaaaaaaaaagtgttaaataatataaaagaacaaaggtaactactagaacagaaatacaagacttcctaaataccaaatgaaattttaaaataaaagagtaaagaaagcacaccagaaagtattataaaattaatatagtaaattatgacataaaaatatatggcagagttgagatatctcagtcatatcaccaaatgttaatgatttaactcaagtactgaaatgtagaagatattcatttggattacaagacaagacccaactaccttctatgtataaaagtcacatctaaaacattgttattgtaaacagtgctacaacaaacatagtcaataataatttatttgtacattttaaaataacagagtgtaactggattgtttgtaactcaaaggataaatgcttgaggggatggataccccattctcaatgatgtacttatttcatatcacatgcctgtatcaaaatgtctcatttaccccataaacaaagaaatatataaatatatcctactatgtaccctcaaaaatacaaatttaaaaaatttcaaaaaaaggtgaacaaaataattttcttcagaaaagtaaaaaggaaggaatgaaataagctataaacagtaaatgaaaaaataataaagatatagtagtgatcctgatataaaacaagaattcaactaaaaaagtattacacatggcaaaggatactttttattgctaaaatccacagctaacaaagaatataataggtataaacatctatgcccccaaaaacataatgtatttacaaagtcaatagtagtcatatataaaaccaatactcagaggacataagggtagcaaaaccccattacaatggcaacaaagatgaaatacttgctaatagcaagaacacacaaaacctgtataaagaaaactttacagcacccatgaaagataatgtagactcgaacaaatagaaagacatcccttatctcaggtaagataattcaacatcttaaagatgtcatttcactctaattaatgtataaatttaatgcaatcccagaattactaatagactttttatgaatctggacaagtggacactaaaatttatagggaacatgcaagaagagctagaaactcactgaaaaaggaaatctcgatggggaactttccctcgcagacattaaagtttagatcccataattataacagtgtggggctgctgcgtaaatagccacatagactggtgggatagaatacgacatccagaaaaacacccaagaacatatgaaaatttaaaatatgagaaaagcagcatctcaaattatcgggacaaaaatggacttttaaatacatgttgctaagacaactagacagacatttgggaaaacagataaaaattagatccataatttacatcacacacaaaaacaaagaccaaacatcagaaaactaaatataaaaatactaaaatacataagacttagaagcaaacatgggtaaattcctttatagcctgagtgtaagaaaaaactttttaactgtgattcaaagtttaaatgtaataaaagaaaaaaaatgattcatctgacaacattttatttgctgtggcaaaaatataagcaaagtcaacagataaatcacaaactggaaaaaactgcaacatatatcacagataaagtactgatatctctgatatataaataactttaaaaattgatagaaaaagtaaaaaacaaactgaaaattgagcaaaagacataaacaggtaattcaaaaattacataaaaatggctattaagtataggagaatatagcaatttcacttataagaaaaaggaaattaaagctatattgagatataatttcttacatgtaagtgtgacaaaaatgaaagttagaccacacaaactgtttacaaggcagtgaggaaacagtcatacattgctgggacaaatgcaagttggttttacccttaaggaaggaaatttagtgacatctagcaaaactgtgtattagtccaccctttaatcctacaattcctcttctaggaattcactctgaagacgcaccttcaacaatacaaaaatatatgtgcacaagttccttgatgcagcaacatttgcaactgaaagatattgaaaacaatatagccacacatgagagtggccaaataaacagctataatcacataatagagtactgtgccgggcgcggtggctcacgcctgtaatcccagcactttgggaggctgaggcgggctgatcatgaggtcaggagatagagaccatcctggccaacatggttaaaccctgtctctactaaaaatacaaaaattagctgggcatggtggtgggtgcctttaatcccagccacttgagaggctgagccaggagaatggctggaacccaggagggggaggttgcagttgagccaagatcatgccactgcactctagcctggtgacacagcaagactctgtctcaaaaaaacaaaacaaaacaaaacaaagagtactgtgcagctgtaaaaaaaaaataaggaagacatttatgaaataatataaagtgatacccaagtatctatagtatgttagcttttctataagaaggggaaatataacatacattgacttcaaaattttcacaaaaaaaaaccgccaagaaattaatgacattggtttccaacaggggatggtagaggtgatgtaaaagaagtgatatgtgcttttctgtatgcacttgtttgtacagctaggcttttagaaccacgttataatgtttttagaaccacgttataatgttttacatattaagaaatcaacagggatgggcaaaatgaaactaaaattaaaaacaaagagtcataaacaaacctaacttaatttccaataaatacataaccatattctagtgaaagaaaaaaaataaaccaaataattttcaacacaacggtttgcatatatttagactgaagagagaacagaaaatatatattgaaccctagttagtaggtttgttttgctaagattaatatttctggaaatacttcttgagtattctatgttgaacaataagtaaatatatgaataataatgaagttaagcttctcactgtcagagaagggaattacagaaatgggaagagtgaaggctggaataaactccttgatgttggactagaatggaggtatcatgaacttttgcctttttttttttttttttttttttgagacacagtttcactctcgttgcccaggctggagtgcagtggcgctatctcatctcactgcagcctccgccttctggtttcaagcgattctcctgcctcagcctcccgagtagctgggactacaggcatgcaccaccacgcccagctaattttttgtatttttagtagagatggggtttcaccatgttggccaaaatggtctcgatctcttgacctcatgatccatttgcctcagtctcccaaagtgctgggattacaggcgtgagccaccgcacccggccacttttgccttttatgatagatagctaaaggctgggtgtggcggctcatgcctgtaatcccaacactttgggaggctgaggcaggtggatcacctgaggtcaggtgtttgagaccagcctggccaacatggtgaaaccccgtctctactaaaaataaaaaaattagctgggcatgatggccggtgcctgtaatcccagctactcaggaggctgaggcaggagaatcacttgaacctgggaggcagaggttgtagtgagccaagatcacgccattgtactccggcctgggcaaaagagcaaaactccgtctcaaaaaaaaaaaaaaaaaaaaaaatagacagaaagatagatggatagacaggtagagggatacatagacaaagagcctagaatcagtggtactcactaacaatgattcccactcgttcccaggtctgagtttctataataagtaccattccccatttaaaggaaccagagctggggcaaaggaagcacaagattctgtcagaaagaaaataagttttcaagaactgctggagacatttcagaatgacaaaagaaccatcttgaaggggctcacactagctaattctgggacaatttgagcataaaagtaaatgatgatagtactgaagtataaccaactgaataaaagaagaatctataaatttttatcaatataaataaattaatacattgaaaataggggagaaaggagaactcatcctcggaatagatgtccactaataaatgtggaacaaatgatggaattagaaaattgtcatttggcaaacatctttttatttgtattattattattattattattatttattattattatactttaagttttagggtacatggatgaaattggaaatcatcattctcagtaaaatatcgcaagaacaaaaaaccaaacaccgcatattctcacttataggtgggaattgaacaatgagaacacatggacacaggaaggggaacatcacactctggggtctgttgttgggtggggggaagggggagggatagcattgggagatatacctaatggcaaacatctttgtaatagttgatttcaacaaaaaatatcagcaaatgctaaaagatgaaagtttgaagaagattttacatagtctagaaatatgtgtgtacaaaacacttatatattacaaagaaatagtagctttatagtggagaaaaccttaatggacaacagtttaagtaatcaaagttaatgtcaccagtaatggaacaaactgatatcatgtgccacctagtatgacacattgagaaggaagcaacatcacttttgtggtattcctgacaaaaatgcataacttgaatctaatcttgagaaaacctcagacaaacccaacttgagggacattctaaaaaataactggtctgtaatttttaagagtcaagggcataaaagtcaaggcaagacagatatgagaactctaaagggacctgacaactaaaggcaacatgtgaccctggaccaggtttttttttgttattgtttaaatttactaaaaagtatatgactgagacaattggcaaaactgaggctagtagtattatgtggacattaatttcctggtaattgtattgtagttatgttggaaattgcgcattaaagcatttaggagtaaaggggtgatttatagacagatagatagacaaacagacaaataggggaagaagagaaagaacaggagagggagagagagaaaatgggatggtaaatctattgtggtaaactgttagcaattagggaatctgtatagagagcttattaacattctttacactattcttgaaacatctctgtgcatttgaaactaccttgaaaaaaaggagttagacatattggtggaagagaaagtaagttggaacaaaaacaaatttgacgatgggttgatgatcattgttgaagctgagtgacgggcacatacagatcagtctgttatcatcttgacttttgtatgtgtgaaacgtttcttagctaacaacgtgtgttttaaaggtgagaacaatacatatggagtatgtcatcaataaaaaattgagacattcaaattttgtttttcccaacatgagtgacattgggtacattccttattttttttgacttacagtgttctcatctgtagaatgggagcaataccctctgtacaactctctagggtaaacaaaattttgtgagcacaagtgccttaaggatgcaaatatatatgcatgactttatgattctaataaattgatattgagattataggcaagacaatttttttttcttttccctgttttcaacagaataaatgccaagtattttagcatggcatacaaagcccagcattatttgatatctgcctctctctgggcttcattccatatcccggaaccaacaccgggattgtcttcccaaatgtatcagggaatccccaattttggggcttctgctcaggtgcttcctttgcaaaacatacactttcctctgccccactgtctacctggaaaatatccacttaccttctaatagccaagtcaaatgtcacttcttctacaagattttcctaggcacctcctcatcccctctacctccaggtttatagctgaacacaccaggtattctgccactgggattgctgataatttattgcccacatttgtcttcatggctgtcttctccactggattgtgggttcgctgagggcaggaactgtaacttatttatctgtattcccaactgactcacaacaagcccataataaataattggtgggtttttggggttttatcatcatcattcatatctccttacagaggagctcatgaccaatgaaggcacaattctgcagagtaaacaaatgcaaatggggtgtgggagactgggtttaagccatggctctgatcttgagcaaataacttccccatactggacttcagtttccttttatctgctgaaagaagagaactggacaatcaataagctcccttccaatactgcattttatacttcccattcctcaacaataggactttgaggctgtgtacaaactatcccctaattgagaagttggaaatgtagtttctctgcacctcatgaagagggacttagactttctattaggagctggcaaccccctggtttaaaccaacccaaaccagagcagtccttcatgcttccctgcgcagctcttatctgaccttaatgattcctgctctgtaagagatccattgagctgtaattactaattgatgtttgtaaagtctttgaaattctcaggtgacagatgtaatcaaaggccaatttattatgataattgttattagtacagctcctcactatttgttgatgttaatggcagggccagcaggtgtttcaagattgactgagggacttaggctggccatgtttggcgggaggaaaagaaaaatatgagtgcataagggatttgggaccctcctggttctagtgcacccatattcctctatgaagctatcttgtgggactagggctcggcatgaaacggagcagtaaatgcataggacttttaactgcatttttcacatgcacagattcaaccccagctcgttctcttgtttctggagtatgcttcagcaaatcatagcctctcacagccttggcttgcttgtgtgttaaatgagaatacatatagtgccaatttacacttgctgtgattcgagaatctgtttgagacaagcaatcgtggatgtgggaagaagcgttaggagactgttgaggttgtccaggcagaagatgttactatccagaactacgatggtggcactggagatgagaaaagtgcatggattagagagagcttcagagtgtagaacaaagagaacttggtgatggctgaatatagaaggtgatgtatagcaggaaacccagactttgctgataggaaagatgcaggaataactttgaaggagatgaatgaatcattgcctactattttcatcagtgtcttgtacatatggttcatgtcaatctcttcaactgtgtagcccaataaattgcatttatgggtttgcaaacttgaggaccatgatgtaaaagatgacacttgatgaaaattcagcctctaggaggaaagggactgcagaagaattgtcccacttctccacttgcctctccgtaagtacgacattcccaaacttcctttgacatctcaatccctctctttctttcaggcagccagtgtgtcagctgccgtctctggaaaccctggacttcactaatttttttcctcctcctgaattccctgatcccacgtcatgttcatactctattcaaatttgatccatgggtttaaaaactctgcccctgtggattctgcttgttctttcctgagtgtacctctatgctctatcccacctgtgatatgtaatagcaatatctgacattaattggatgtttattgcatgccaagccccgtgataagtgttttattcatcttattatttaatatttagaaacattcttataaagttgatactatgggtgttaatgttttccaaaagaagaagagactcagagagcctaagtcacttgcctaaggtcatgtagctggtcagtgacaatctatgcaacaggaaagaccccatgctagacatattaatcaaaaatgctgaggtgaaacaaacttggaaattcactaatcttatttaatagcattaatgccattttatagtgcaagaaatagaatccgtgagtgcaaatgtctccattaactttttatattttaacctcagatttcataggattgatataagagggactaattgagtgtttgagcaaaaatgttctgatgacattgaccagcatcaactcagggcttcttatacaaggatatatgtgataaatcaccctcttagtgtctttcatgaaaaatatgtatgcttccttcaagtaagagaagctatgcaaacctgccacctgctctttttttccttggcttcgaggaagctcaggagatacagatagtgtaccctgcgctaaccacctatactaggcctctggtgcaatgattactctttattccactataagattcttagactaatttaaactttttattctagggcctggtgcagtggctcctgcttgtaatcccagcactttgggaggctgaggcaggaggattgcttgaggtcagcagttcgagaccagcttggtcaacatggtgaaaacccatctctgctaaaaatacaaaaattagccaggcatgttgatgcatgcctgtagtcccagctacttgggaggctgaggcaggagaatcactcgaacctgggaggcaggttgtagtgagctgagatcatgccactgcaatctagcctgggcaacagagtgtgactctgtctcaaaaaataaaataaaagtaaaaaaaaaaaattttaattgaacatgtatacatacatactcatatatacacatacatctatatatatgcatgctaaaatatttatgtgtatatgcacatatgctgaattcttgttctgtatataaatttcataaaatttacagttaaaaatttagattcacatacccaagtgtttccaccaaagatacttcaaagttttccaataactgaattgagtatcagttttaacatgtgtgtgcacgtgtgtgtgtgcgtgtatgtgtgtgtgtgtgttttagcaagtatacctttacctgaaaggtcctttgcaaagagttatcacgcctaccatttacttgttacaaaggtcctagtgagcttgaaggacacatctcatccctgtttgacagaggggaaactgaggtttggcaggcaagtattctgtctatggagctaagaaacggaaaagccagttctaaaacccatggataccatttccaaattcagaagtttctctactttttcaccatctgagggcaatcagtccaagcttcacgaggttccttacattgtaggggcctgatggaggcagagatgctgctatatagaaactgaggctgctatttccatgaactttgttgggactggagtctggagcatttatccctgaaggcccaggctgacaagattatcagctgtcaacatttgggtaaccttcatctccctttccaaatgaatttaaagtatatttgcatgggaaggaaaatgttcctgctccctcaggtctcataccatgataataaaatctgtagaaactgtaagtggatgaaaaaataaattagcaacctgggagagctcatcttggtatctgtacaaggtgacacttggggaatttctatcttacctaaggagagaagtctgggccccaacagagctccagcaggggtttagagttttaaggctcaaacaatggaatggaggcctggaagcagggatgcccaagtgagtgggtaagccccaggagatggagtccactgaggactgggaaagagttctaggcagataaatggggcatggaacctaggctctggtgacagacaagagctgtgagtggatgtttacccgattgagattttcctaaggagtaatggaaaggttgtgatgataatcctggaatcaaagtgtctagttcagtcttcctctccacttcaacagggctctgcagagctaataaaatccaggaatcgattccttacatagactatagtgacaagtcagcaaacggttacgtgggggcctctgggtcacagctctctgttgccttggctcagctaccgatgggtggtacaggtctaaggtctgctgagttatagaagcattggaagaccgttgcttttcagggtggaacaggagcacattgagtttcaggcatttctttaccattcctccatggaggtaaaggggaaaagctgttactaaaatccctccttcagtgtgaagtaactgagaccccatgggattccaggagcctctaggtgttcgtccatctactgaaaaaatgtagtcactttgtgagaccaatcaaggaagcagcataggtgaaagcaccttgcttaatatctgagacacagcagatgctcaagcaattgaaattcctcaggatttgtggtatgaactgcccaggtgcttcaggagcaagtctgggtattataagaatatgaaggggaggcttagtcatcatggaaaattgtggtagtcattggggaagttctcaaatattccagttctcctaggcatatagaaggcactgccttattctttctgaaattaagtgtggccatgtggttagccttggccagtggaatgtgaaaatgctatgcaccactttgtatggaaacttgtagaacgaatgctctatttgccacatttttctttctcagacttggtggtggtgtcaagatggacattctgttggcctgagtctctgcctgcaacaagcagagaccctctgctgacccatttcaaatatatagcagaagtgatccagtgagattttgttgttgttactacagaataatttagcttatcttaaccaatataggagttttcaaataaacttcctgatggggtatccaagacccaaactgccatgtgatctcctgatgatcttaactcgaaccctctagagcttatatctacagcttctcattccatgtctatctgaggttttcataaggacatgcgaacagtcactgaactaacacgagaaataagaaatggggtagaaagggcaatatcataaccaaaagataagatcaattgtgccaaaagactcaacaggaacagatatcaggcttgaaactgtcagagacctttgaaccagagcaactccatcttgaataggggctgggtaaaataaggctgagacctactgggctgtattctcaggaggttaggcattctaagtcacaggaagaaacaggaggttggcatgagatacaggtcatgaagatgttgttgatgaaacaggttgcagtaaagaagccggccaaatcccaccaaaagcaagatggtgacaaaagtgacggctggtcattctcctgctcattatatgcgaattataatgcatcagcatgctaaaagccacttctaccggcaccatgacagtttataagtgctatgacaacatcaagaagttagcctatatgttctgaaagtgggaggaaccctcagttccgggaattgcccacccctttcccagaaaactcatgaataatccacccctttttttttagcatatcattaagaaataaccacaaaaatggccaaccagcagctcatactgctgctctgtctatggagcagccattattttattccttaactttcctaataaacttgcgtggacttgcctagaattctttcttccacaagaaccaagaatcctctcttggggtctggatccggacccctttccagtgacaaaaccatgtatgagaagttaaactaagaggaatacagcctggggtgagtcatgggtgagtcaaggcggtcatcagctgggacacagacacaagtcctaaagtcctccaaagttaggaaggtgtgtgcttctatgtggagtttactggacaaatcggtatatgccaggtaaggatgctccaaccctcttccccctcagaagaggagcctctggaaagcagccaaaagaaaaaagaacaaatagtccaactgtaatgcgataagatactttaatatacattgtctaatttactctctcccgatttttttgaggcagatcattaatcatattttccatcttgagatgttaagtaaactgttcaagttcacatagctgagagcagccaaaattcaaagccaagtctgtctgatgctcaactctcagttctttccactctatcatgccacagaaaacccatccatgtgcaaccatttctttaacagtggttggacacaagtgaatataatttctcccaattcattcagagacacagaattttccctaacctagctctacctagataatccccactattataacgtgattatactgcaagcatcatgaccaattcaacacagcatctggtttccaagtgctctcaagaggcaattgagttcaagaactggaggaggaagtaggagagagagaacaatcaccctgctacttcccacttctcttatttagcttagcatttggcagaggcatcatccaggttaaatgtacccctacatgatggaaaggatatgacaagaaaagacttttatcctctgcataaatagaacatgcataacagcattgcccaacaaaaggtggcttctgatggatatttgcatgagtttgccacacttgttttgcatccaaccgttaattatggtcctttcaacttcacaattacggctaatggtggtgaggatgcagagaacagtagattcagcagacctcattctgggaagagtgtgaaacaaacaatgcgaaactgcacccacccgctgtttagaactgagacagctaccctgggtaccatttggaggatttggaggaaatcaaggctgcccaggagcctggagcttgggaaatgagacatctggggaaaaaaatcttactactatgatggagaaaaaaggtcctttaggactcttttatctatggtgaaaatggctcaaacaacatctctcattctacgctgaatggaaattcagactgtactgacacctacttggtgcttttcattattcaatatctttttcttatttaatcctcaaacagactgtgtgaagtatatattactatttcaatttataagtgaggaaacagattcatagacaacaagaaacagttcatagtctcattctttcattaatccatcaaatgattattaggtgtctattatgtgttaaatagtacactcagcatggaggatatagcagctaaaaaaacaaaaaacccaaacacaccaaccacaattcatcactcttggagctctcagcatgctgtgggaggcatgcagtacccaacaacatgtgcaaataaaatacatatatatctagtgtaatatagaaagatagtgggttaacatatgagtgagtgctggtgggtggttcttaggtaatatggttggactcttctctggagatgtgagattgaaactcaggcctgaaaaatgagaaggtactagctctgcaaacagtgaagaaaagacagatgtaggtaaaatgcaccctgaattaagaccccaaagtgaaaaacatgttggaatgtttgagaaataatgtcttaggaaaggttcaagacacgaggcttagttaaaatctagcaggcatgtctgaaccatatctgaagaacagtgataggttctgggcaactctttttgaggagaacatgatggggaaaatgagcctatcagagaaaagggtaagtaggatgaaggatacccagaaattatgccatgtgaaaaataaaagaagtaatagcatgttaattatcaatgagaaataacttgagtggccagaggagggtagttggtactgtcttattttctctgaaaggctaacaaaggaaagaacgttttgatttgttcaaaccaatacaagtggctacaaggggagagtcaaggagacagaatttagctctatatgggaaaaaagctttaacaattttacctgctccacaaaggaatcaactccctttcactccagcaatttgcattgatcaagctgaagcaatacaatgtgttgctaagaatgctttattggagattttttttttggcttctcgtctagactagatgacacttcaaagtccttcctactctatgatgctatagttctataatattgctatatccaaaacaaatggttacaacatggtctaattcataagagacaggtgttgtgaattaggcaccaaagacagtgtgccaggacaaatgggactacatttttatctgtaagaaggcatcaatggataaatgtgagattactaattggaacaaaattcccaacacaagtgcctgtgaacaactcttgtgtcatgaaaatgcctgcaagaaccctgagcaacatatcttatagtgcatgccacacttgaactctgcatggtgttcacatggctggattaaaatacttcatattcacagatcaacaaagagtctataaaatgtctttatcctcatgctgataatagtaaacatttaatgactgacttccacattcctaatgtgaaacctaaggattcattattcgatacattatttcacttatttatttttgttctctcccccactagaatgaaaacacgatgagatcagggatctttgcttgactcactgctgcattctcagcactcagaaaaatgccttttttgacatattgcatgtgcttgacagatgtttccttaattaatccatcatatctaattattttagtagtttactgaaagtcacacagctactagggttttgtacctaggcagtctgatagtaaaggttgaattcatagccactctgttaacctgacaaaccatccttaacatccatagaacaaagatgtccagacctcagaattctcctacccttccttgactaaaacttgcaggtagagtagggagcaatgaaatttgctgatagtaaattattccacctggctcacaaccatcctgcaacaaatgcccatttctgctttcctttcacttgaggttaatataactctatctcatcctttgtctttaatcttttagtgacagaaatatgggtaattctgatttttctttgacctaagctgttttctttctctttcacaatggagcaaaacaacacttttttacccccccgtcaccccatatcaaatctagtgctttcatcttctggctttttttatagttttgattttcatgtttacttatagttttctttattttcttcatttttcttcgttgactgttgtttctcagctttttaagtatagattggagagctgactttgtttaaaagaactatactttttagtattctcagtatcagaaataaaacagtaattatgtattccctcttgtctaacatgagaaaatgagcagatttttatttacattcatccatcttccaactttgtcttagtttttgttgataaaatagtgaattatagatccagattagaactgttaagtttttacattatgcatctttgccttaagtagttacattttacattaaccttccattttgtaacacacttagagccattattgagcattaatgctatgtttaattagttttatgctcactgtaggtcttcgtattccacatttctcaattcttgatttctttattttgattaattgctcagtcaattgctctgtgaatgatttattagaagcagggaacgtgggagcccctggataccgagaatggctttctgatgtatttgcacacgaacaacaacttggctgataaagaatttgtggattataacactttctcctcaaaaatcctccaggcttaacatcattgtctgctgccctttatgatatggaaaaatttgagagggaccaggcagagatttgttagactgagaatggctgttctgcttcaatgaccctttcacccaactcttctcagtaaaatttaatactaaagacagtcatttgaaacagtgtgtagtttttcctttgccagaaaagtacagccttctgagtgcccagctcccattgcttttcccctgtctgttcctgtgaggtcaagtgcacccgcaagacatgtggcataagcactcatccaattccattcctgcctgtgtttcgttactgggaatcttagttacaaagcaagagtacatatgcatggtgtggaatagaaggcacaggtaattaaatggccttgttcatttctgaagcagtgtcaaaactgcttctgagatgaggcagtttcagagtgagatccttttttttttttttttttttttcctctatggcaaatccctgagtcttgaagagggaggtctctgatatgatgtttggggagcaaactgtcggaggcatttgaacctgagcaactccatcttaaataggacctgggtaaaatgaggctgagacctactgagatgcattcccagatggttaaggcattctaactcacaggatgagataggaagtcggtacaagatacaggccacaaagaccttgctataaaaacagcttacagtaaagaagctggctaaaatccaccaaaactaagatggccatgagagtgacctctggtagacctcactgctacactcccaccatcatcaggacagtttacaaatgccatggcaatgtcaggaagttaccctatatggtctaaaaaggggaggcatgaataatccacccttgtttagcatatcaaggaatagccataaaaatggacaaacagcagccctcagggatgctctgtctatgaagtagccattcttttgttcatttaccttcttaataaacttgctttcacttcactatacggacttaccctgaattctttctcacacgagatccaagaaccctctcttggagtctggatcaggacccctttcctgtaacaaaacctctgtggttggctcagggccaaccactcttatggtgaggacattccttctgatgtgcatttgttggtttcccgggttctatagccatgctctatttctaggttttctgagtatcttagtgggaagaataaagtaaagctacttctttcccatctcatcatggaaacccaaccacaacttttgatatgtgccaagagcagggaaagccacaccttcttagagggttgtgctgaactgataaactggccagtgtgggatgccgagaaccgagaacaagatgagtcccagatgcttctgccaatttttatgtcttcctgctcaatacatcagagtgcttcatgcagcgggaagaccagatggacaggtggaaggcagtctggcagcttctctttgtagtcttatgctctctgtgaggagtgttgcttgaaccagtaataaatgcagaactgaaataccacagtggaatttaaatgggtatgtggacattctaaatgttaattagttcctcaatccgggtttctcaccaagcactgactgccattgacagattaaactctcaatcttggccacccagagcctgcccaggctgttccccacacacttcaccaaatcttgcttctgtctcaggcttcccttctccagcaagcttctcagttctccatgttatacactgcataacaaggcacatgacagactcccttacatttctataagctcttggagggtacatactacataaacttaatatgaactgtagggcttagcatttgttggtgtttgttaaaagaaatatgaccactttggggctgggcacggtggctcacgcctgtaatcccagcactttgggaggctgaggtgggcagatcacgaggtcaggagaccgagaccatcctggctaacacggtaaaaccccgtctctaccaaaaatacaaaaaaattagctgggtgtggtggtgggcacctgtagtcccagctactcgggaggctgaggcaggagaagagcgtgaacctgggaggtggagcttgcagtgagccaagatcgcaccactgcactccagcctgggcaacagagtgagactgtgtcaaaaaaaaaaaaaaaagaaagaaaagaaaagaaaagaaaagaaatatgaaaatatgaccaccttgatggaaaatacaaacttgtgtaataaaacaggctaaagatatttagcttgcagaaaagacaatcttatgggcacatttatatagagaagaaaagggtgttagaaaagatcttatgtaactgaaagactataaaccaagaaggtggttgcattggttttgtaggatgctaagagtgtgaatcaagaacaatggatagaaacttcaataggaaatatttcagtaagtacattaaaaagcctccttagagacacagcccactccctactccagaaaacagtaaagctacctcagagataaatgagttctctgtcattggaggtattcaagaataagcactaatgccagttaattggtgttgtagtatggatagaaccattgttttgtgtgtgtttgagattgttgaatgacctttgatatgctttccagccctgtgattttctaatattatgactggtgccaatccttgaccaaagaaatatttgacacaaaaatggttaccttgcgtgaacccgggaagcggagcttgcagtgagccgagattgcgccactgcagtccgcagtccggcctgggcgacagagcgaggctccgtctcaaaaaaaaaaaaaaaaaaaaaaaaaaaaatggttaccttgtttttgtttttggagaaacactattttctaatgtgaccaatggcaatgaaaaagggcgtattaatcactaatcaactaaaccatgattagtgcattcctagatagcaaattgatagatattattattatatatgaagaacttaaggatcagagaggtcatgtaatttcctcaagtaaagcaccatctctttactttaatacaggagtgtgcaaaggttttatgtaaaaagccatataataaatatcttaggctttgtggagcatatagtctctgttacaactgttcaactttactgttaagcatcaaaacagccatagacagtatgtaaatgaacaggcatagctgtactattatttttttaatttaaaggcatgaggtaggatttgccccacgggccttagtttttcatcctctgctctagagccctgctgacttatcatttgagaatgaaaaaatgcaaacaaggcaaggaatggcctccatgtggccatacttactccattggctttgctgagtgcctggaagtagatgctgtagcttttcaggggagagagaggagggttccagtagccattgtatgtcttattgtcacccactgtaaatggctgggtgacaggcaggttggcaggcttcaactcagcagcaaagtagtgtagagaatcgaggctggaggcattccgatagctcacgggcaccgaaaagcactcaataatgtcagctgccctccgtgacttctgaagtcgctcctccttgacaaccagctgataaacactggacaggaaagaggagacacagatggttgagcaactttctggaagaatgagcttgttagctctaatggtgtcaacccaacttctcctatgtggaagcattggttcggtctacaacaaaactccagtcctgagcatcagattttcaaacctaccacgttgtagaactttacctccacttagctgtctcagagccagctcacactagacacatctaaaactcaacttagccccaacccctacaaacctgtctgctcctccttctacatttcctttcttagtaaatggtagcagcatctgacaagtggccagaatctgaatctagggctcatcctcagttcttaactccttcgttctcactcctcatcctaatcaacagccttacagaagtctgttgatttggcttctgcaggtttgcatctgccccacctctcttttctccttccactgataatgccttggttggacactttcccacttacccagattcaactagtctctttgcctctaaggcacttgatttattaatcactcatcctaatcatatggcttcctaatcatatagctcttcaaacactttcataggccttccattgtccaaattatacaatctgaactcctaatcttggcatttgaagtcctctgtgcctgccttctgtcttccatttagaaggtcttctcatggtgttcccatcttccagctactccagaccccatgctattgcacagacatcttttggatctcacctcatgcattactgacttatgcttcctctacctgcaatgccctgcatcctggccacctctggtttcctccaaaggctgagcatgtctttcacttcctctatgaagcctgtccagatatgtccagtctggatgaattacctccctctttagttcccctagagctcatctaatctccatctgctttgttttccaatatcatgagatgggactactctttcactggctagattgtgaccttttacaaagtaggcattgttgcttacttatctctgcctcattctccacccccaccccatactgcccagcaggatgcctgtcacccaacaagtgatcaatgaatgcttgttcaaatgaattaaattggattgaattaaaattgaaagcaaacatgaaaccaaatctgcctggatgcagaaaccctaatcggataaacagcgattgccttgagttcctgtctagtgatctcatattgttcccttcaagttagaaggatgtaagaagatgctagtgtgtgaatagagatgactgatcctttattgaatatcaactgatacccaatgttagactctctttgtaaaagttcttttaaggtttgtaagttggagaacatttttcaatctctttgaatgccccacagtttatagttctctggaataaatgctcttcttttagaagagctttattgcacagatctctgggactcatgatctaaaacagaagatcgattgcccaaagagtacccactggagacttctgtgaattaatgaggtggttgcagtaggggaccccaaaccaatcatttaaacagggcatagtgaaccagcatgtggtttatcaaaaatgaaacgtgttgcaggctaccatccttcaatcagactatccatctaaagacacttgattaaggagtacaacttgggagatgacagagacacaggactatttcattaaggaaaaaaggctatggagaactgccctaagaaaatgtgacacactcaatatggcaagttttcccctgaattttcttgagcataggaattttcaggcatgcgaaaaggaagcgctgggcatatgagtatatgccacacttagatgagtgcaggtaaacagcagctcaatgaccatgcctgttgtacatacacatctgagtaagaacctgacagttcagagtgcatgtgagtgacatgcgagtggatgtggacaatctctcaagaaatgcacactacatctgagggtgtaccatttccaagtgaggatctgtattacctgggcatctaactccaaatgagtaaatataacattcagatgaacgtggctaacctgagtgtttagacttctaaataagtgtgtgtaacatctgagaaggtgttaacaatccaaagtttgtgtgtgggtgtgcaccatctatgcatgttcataatgcctgttgaagtcaataaacgtttaaattaaattatgatttcaataatcacttcctcctcaactctggggtccttctcaactgtacaattcctatgtttatcaggacagctaagctcaaagcagtcactgaaaaatagcacaaggacctaatacccaaacctagaggttgcagggcagaagtggaggggtgtttgtaacagagttttcaggacctgcactgctttataaataacaatatattcaggtaaatctttgaatctggcttgaatgctaatagtagctcgaccagttgagggtccattacttgtgggactctgatctgtgagggaaagggcaaacacaaaagagcttcatgaagcagacaacctcttgggctctcctgctgaagctaacaacagacctaagaacactgcattggatttgggagcatgcaaccaaagcagtcctcatatcctcttcagcagattagaaggaaccaatagcctcatccccaggaccaggagttggaaagagctgggagtccctgctttcttctgagggccagcctatccctaatcaccgcttgaattgatcacatctacataacaaggcctttgtcttgctttctcagacagacttcccattctaccttaaatccttctgtcatctttcccctctaaattgagacccccgaagccttgggagcttccctgggactgaatccccctccaagaatcagttcctactgtctctggccctcccgtgatgggatggatcaagaggaaccacatggctgtcctcatttactgtccacaactagcataagattccatagttgtggccaagcaagaagatgggttctcactgggctctgaacattcaaatgctgccaaggactattagacacagccataatatctctgtgagggtcagcctgtatatccccatcagctctttctccccaccaatctgattactgaagatccacttgtcaattcaaccaagctcaaaagccagattacacatgaggaggctgaggccgagaggtcaagtgattcatgagggtcaaactgcagcaaaagtagaaacccagacttttcattcatagctcagtatccttcctttttttttttttttctattttcttctcttcctacaaaccaataaaacgtataaaggggcttccaagcatttttttttaacttggcatcctaaactgcttagctctatcccaaccaactccatatgaaattacaaagaatagcaaagggtatttttttttggtttaaactgtgcagtcaacatatggttcacatacgattgtgattattgtgccaaaatatacccagcaactccttcaggcccatgcattcacagcctgtccattcaaaagcaaacctgcaatgcagccagaaaaatttaaatcattttgttagataaatctgtttgccagtggattcagcctctctcaaagaccacagaactctgattgaagaggtggagagaagaaacagcactcacaagttgtataactttcctttcctgacactttttaggaaagggtgggggaaagaaacaagaaattgggtattatttgtatttcttgcaatagcttcattctcattctcttgagaatacatttatctaagagcatgttcttttcagcttgctggtaatgataaaatcatatccaaatgtgaatgacctcccttttggggtcatatctccagctcaaaaacagtggttgcaataatctattcagaatcatttttaaagagaaaggatttttttagtaggaaaaatcccaataacatgagagaagaataacctaagacactcaccacacagcacatagcatttactcatacattttctcctcttgtgacaccctctctgtttcttccaatgagaagatgggcatttatgacctgttttttcattacttatgccaaggatctcttattgcaaggatctaagagttatactgtgcccccaactaatttcattcactctaaggtgacttctgtaaggtcaaggagagtttgtactcttactttcagtatctcctgctgtccatccaaggcaaaaaccctcagaacctctccataggctttggaaaagcctgctgcttgaccatcttcctccctctggaccctaagctaatggtttaaatggtggcttgagattctcggaccagattccactgagggggaccagggacctatcagagcctccttccatcagtaacagttcctgtggccctctttctatatctagaaaagtttctagctaggaggtgtatcctttcagaaagttgaagtcaggtgacagatggagtgtatgctttagctcacaggtacagattgcccaacttcagaaagatgcatattttagtccacgttctcccagaaggaggcatgtctgagttcaggttcttccagaaacagaccctgagccaaagtttcactgcaaatgatgtattgaggaagtagtcccagaagaaactagtaaaggagtgagagaaaatgggaggaagtggagcaagggtgtgatatcaggcaaagtcccagtcttagcctgatctcatagggagctctggagcataaattatacccccagcatttgtctcatctcaaaccaaaggcttttgaacctccagtgctggtcagttattggctatgtctgcaccagagagacataaactctaaggcactcctaactttgtgtgagggtcagacaaggcggctctggcatcttaatggcaacatcccacagcaggtcacacctggaagccatttacatcaaagcacatggaagctgggagacggacacacagcagaaaaggggaggtgacagtgtctgggaggccagcaagagtggctctgacagggcagctttggacaatgaccatatgagacttgtgaaaggatcagagacctattttatcaaggtaattttcaaactttgtttccagcactcctcatctgagagatacggtaatctctcaccaatcatagtggcttctccatcactgattcttcaagtgagggcagtgaacagtcatctcagaatctcaatggagggttgctcaagatcaatagttctcaacttgtggctgcatattataattacccagagggctttcagaatgcttattccttggctctactacagatcagctgaatcagaatctctaggggtaggaccctagcatcagtactttttagaaaagctctctagatagttaaatgtgcagctacaaaatcataaacctaggtgattctgatgtttatacgcttgcccttatgtttattctgatatttatacctgtatagccaacaggggcattcccctccagtattctcactcccttggaagacacactgatttgagtcattccaatttcaccaaagcattaatacataattaccagtattctgagtcgttgtacaccacatctcctgatttatttcttccacagcttttatcataattgaaacatgtcttatttaattatttgtttactggctttactgcttgcccccaaataggctgccaacttcatgaggtctgagatcttgtcatctaattcattgcttctaataccatactagacacataatggtttttcaataggtatttcttaaaaaaaagaatttaaggtcgagcgcggtggctcacgcctgtaatcccagcactttgggaggccaaggcgggtggatcatgaggtcaggagatcgagaccacggtgaaaccccgtctctactaaaaatacaaaaaaaattagccaggcgcagtggtgggcgcctgtagtcccagcttcttaggaggcggaggcaggagaatgccgtgaacccggaaggcagagctgcagttagccgagatcacgccactgcactccagcctgggtaacagagcaagactctgtctcaaataaatggaagaacatttcaacaaatgttaagactccgatacaaacaaatggaagaacattccatgctcatgggtaggaagaatcaatatcgtgaaaatggccatactgcccaaggtaatttatagattcaatgccatccccatcaagttaccaatgactttcttcacagaattggaaaaaactactttaaagttcatatggaaccaaaaaagagcccgcatcaccaagtcaatcctaagccaaaagaacaaagctggaggcatcaccctacctgacttcaaactatactacaaggctacagtaaccaaaacagcatggtactggtaccaaaacagagatatagatcaatggaacagaacagagccctcagaaataacgccgcatatctacaactgtctgatctttgacaaacctgagaaaaacaagcaatggggaaaggattccctctctaataaatggtgctgggtaaactggctagccatatgtagaaagctgaaactggatcccttccttacaccttatacaaaaatcagttcaagatggattaaagacttaaatgttagacctaaaaccataaaaaacctagaagaaaacctaggcattaccattcaggacataggcatgggcaaggacttcatgtctaaaacaccaaagcaatggcaacaaaagccaaaattggcaaatgggatctaattaaactaaagagcttctgcacagcaaaagaaactaccatcacagtgaacaggcaacctacaaaatgggagaaaatttttgcagcctactcatctgacaaagggctaatatccagaatctacaatgaactcaaacaaatttacaagaaaaaaactaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttaaaatggcagtcattaaaaagtcaggaaacaacaggtgctggagaggatgtggagaaataggaacacttttacactgttggtgggactgtaatccagttcaaccattgtagaagtcactgtggcgattcctcagggatctagaactagaaataccatttgacccagccatcccattactgggtatatacccaaaggattataaatcatgctgctataaagacacatgcacacatatgtttattgcggcactattcacaatagcaaagactcggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacaccgcatgttctcacccataggtgggaattgaaccaatgagaatacatggacacaggaaggggaacatcacactctggggactgttgtggggtagggggagaggggagggatagcattaggagatacacctaatgctaaatgacgagttaatgggtacagcacaccagcatggcacatgtatacatatgtaactaacctgcacattgtgtacatgtaccctaaaacttaaagtgtaataataataaaataaaataaaaataaaaaaaagaaaatataaattacagcaacaatgagaaactatcacacacacccattataacggccatcagacaaaagacagacaaccagtgtttgaaagaatgtggaaaaactggaaccatcatacattgctgttggaaaggtaaaatggtacagtcactctgggacacagtctggtagttccttaaaaaggtaaacataaaagtaccattcatctagttattccatttctacctatctatccaaaagaaataagacatttccacacaaaaacttgaattaaactgttcatagaagcattatttataatcgccaaaacataaaaaccatccaaatgtttatcaaccaattggtgaatgggtaaacaatatgtggtatatctatgcaatagaatattattcagtaacaaaagaaataaactactgctacaatctgcagcatgaagctccaaaacattatgctaaatgagagaaataagacgtagaagactacatattgtatgattctattcgtatttattaagttatggagaaaaggcaaggccatagagacagaaatcagattagcaattgcctgggactggaagtggaaataggaatcaattgtacatgggcataggggattttatggtgtgatgaaaatattctaaaatgggactgtggtgatagttgcacgatcctatacatttactaaagaattgtacacttaacataggtaaatttatggtatgtaaattatacctcaataaagctgttaagagaaacagactgaataatcttcaatgtcctttcacacttcaaaagtctatgctttggcatttaagtatgcacaaattttaatacaaaatgctatgataaaccattggttttataggataagatgggctaagaaacaagtgtgagctttgtaatgcccaacagaatctagctttgcaattacattccctgcttaaaggtcactcagaactatggagctgaaatttacaatgatatgtcttagttagccaacctttcttccaagactctgggaattcctgtttttactcactatttgcctagtcaaaatagctcgcagaggagacaagaaaatgggaggaggtgtacattcggcagattagtgtcagaattagtgcacgtgcatctttgctttgcctctgactagttcggcgacctattgtcctatctgtctgtcttttatacatttattcatcagacatttattgggtgatgatagctcaataaagtaaacatagcaggttcaaatttgaatgcaacctggccactgggtactgggtgcttagagctcagagtggagaaataatgaactgttcactataatccaatgaagtgagggcagcaagaactctgccagggaaggattctgggaaggaaggaacctacagggcagtgcaaagactgaaattacatgtctaggaagtgcattctagaaagtgctctatgaaagttggctggagccttcacaattgctgcatgcattattattacaatattactgaattagacaccaaagagtggctttgtttcttatttgggcccttctcctatgattgaattgcatttgatacatttaatgaaagtgaattttgtgtagaaatttagaggaagaaaatatgttgggtaaaggaatcatgaaaatccagttgaagcatccaaataagttttccctcaatcatggctcttctctctttcaaaataccatagattcagtccataagcaattcccatggcttcagtttcaatatactgtatattgagaatctgactgcttctcagcatcttcatagttacagctctgaactaagcttccatcatctcttaactggattattgtaatagcctcccaactggtctccctgctttcacttttgcccccaaaatttattctcaaaacagtggctagaatgactccttaaaaacatgactcagctcaagactcccctctgctcaaagcccccttatggctctgaccttacttagagtaaaatgcaacatctttacaatgtctacaagactcactcttaagaactctctgatcttactcttctaattcttctccagttacactggcctctttgctgttccctgaacaccccacacacgctcccatttcaaggcccttgctctcgctatccccttccttgaatggtcttcccttggagataggcaacctaaggaaggcttactttttcacctctgccagggaagtctgtcctgaccactttatttaaaatagcaaccgaaatccacaatatagccaattacactttccctcttaatttttacctaccacacctaacagattaggtccttttaagagagaactgtaagcactgcaaatgtcaaccttcctttgggaaaaagcggctggatcaatatggggccagttaggcaatatttgggtagataaccttgatatggggacctttgctaaagcaaggtggaggttttagtactggcttcacactcgctgctctgtctgccatgctgagaaagtcactttacctctagaacttgcctctaaaatggaataattgtgaccaatgcaataagacacaaaacagaagagatacacattttagaaaggaaagcaattcatcgtcatttgcagataacatgactagacctaatatattgaagcaaatcaactgaaagactgttaaaattaataaaagaattcagtaaagtagttttgtagaagatggaaataaatacactgtacaccatggaaaacaagctagaagatgtaatgaaaaagccttttagaatagagtcctttaaaaatagctaaggaaaacacaaataagaaacgtataggactgacattggaaggaaaataaaactctactgaatgatttaaaagactatctccagcccctagcacacggcttggtagagtgggtgttaaataattgtgctgaactgaagatgaataaatggacagaaaggctgaaatcctggaggaaagcatcatatattgtaaaaatgtcaattcttgccaaattgatgtattgttttctttgagaaaaagcaaattgtataaaatatgagccagttaggtgatatttgtgagccctaaagatgtggatggccataatttgacaattccagtaagatttgttttgttcaaatgggaaatatggttaagaacttaaaaaaaaaaaaacaacaaaggaatgaggctgaaaaaccactactggatattaagttatattatgaagttacaatgattaaaccatgggtactagagtatgagttaaataaaaatggactaggtaggggtgtgtgtgtgtgtgtgtgtgtgtgtgtgtgtatgacagagagagagaaacatataattttatgtataaaattacacgcaacataaattaatgaaaaagaaaattttatcacttagtgtttcagaaattccataattatgagatgaaatcatcaaatttaagacctcgctacatatgaaaaaccacattatattccaatagttcagaattaatttatttactgaaaaattttagtatgcccttgccaaccaaatacaatgtgtgatccttgattggatcctggattgaattttaaaaagctttaaaggacaattaattgggagaattggggaaatttgaatgtgacctatatattagataccagcattatgtcactttgaaatttcctgagcgtgatgattgttttgtggctatgtaacagactgacctttccataggagatacaaactaaaggttttgaagcgtcatggtcactacaagtaaccctcaaatggttgaataaccatttgagagacaagagaaagagagagaaactaaatatggcaaaatgcttatgactggcaaatctatgggaaggatatgtggatggttattgtctcattcttgcaatatcctgtaggtttgaaatcaaagaaaaagataatcttgagtggaaaagaattgtttaagcttaataatagaacaatttacaaaagacaaaagaaaaatgacagatttgtctatatgtaaatctgaaatgtctgaaaacagaataaaaaataaaacaaccaattagaaaagctattcccagaaaatatgacagagaaggaagcaatattttaatattttaaaaatcatatcaggtacagcggataaaaatgacaaaggacacacataaaaatcaataaattatctgaataaaggtatagtctatattctgtatatataatgggatagaaccagaaattgctaaatcaaaattctgcacaaatgaaaacctccaactggggaaaataggaacttaccttatatgatgccttataagtaattctcatatcaaatagaaaatcaaagccacaatttcctgctctttagaaactattactgtgagaacaataatgtttaatgcttatgggacaggaccaaacctgttttcagcatctgaaaagcctttgttactaaacaaaaaagaatgacaataaattaattaagcattccataaagagaaaattagaataaacaacactagagccagatggcttttccaatgagttctttcaatcttccaggaatggataattcccatgtcatagaaacaattacatcagacagaaaaagaggaaaagcatctcaaattgttacaaactattcctctaacatactattaaattggtgctccataagtggatcatttactgcaggtacacaagacagatttagtaatagaaaatctaggaaaatatcacataaataaatccaagtagaaaaaagaaaagtacgatcatataagtagataccaaaaaggcacttgataaaatcactcattttaaaagagtcataaagataaactatagaatataaatagttttccttttcagatttcaaaatacctatttcaaatctacaactaacattatacgtaagagaaatttgctggaggtctagtgtttgaggttggaatttagacaaaaagttcagctattaatattatttggcaacgttgcccggaaagctctacccaaagcaacaaaacataaaaccaaaacaagagctattgcaactgtaataggaggacataaaattatcattattcatagatggtgtgattattagctggtaaaccaagataataaaacttaattaaagaaactcacaagaggtttcagtgaatgagatgaagaaaacacacacaccacacacacactctctcacacagtttccctaaataccagcaaaaaccagttagcaaacacaataggggacagatagcagaagacaccacaagcttaatgttagtaaaacaattttaacaaggtagctatggatggagtctacatgagagtcaatgcctacgtcctgagaaatagtcaagactcagatgaatagataggcttgccctctttcagtgtggaaaagctcacgttaatacatatagtcattttagattaagcaatagtcttaatataatttagaccaattccattggggattgtttagagaatatgataaagggatttaaaaattcatagggaaacataagtgggtaaaaatagccaagaacattttgaacaacaagaaataggaagactagatattaaaatgttttgtaaagctatattaaaatgggtgatacagacacagtgaccaacagagaggcagatctaatggaacagtataaaccaagaatatagtggcacacacacacacacacacacacacacacatacacacacacacacacacacaggcaacatcaccgttcagtaagactggaaggagtattcaataaacggtgtggaggaaatctgtcaactacttggagaaacaaaagaataaatactccccaaacatcattaaaatggtaatagctatcatgatatgtggcaaaagaaggatgcaacattatcagggaggatcaaccttacataaagcctattttttttaatttggtgactaaaaatagggaaaatttcccaaatgtcagtattttaaaaattttcctatcatttctatataagcatgcattattttgtggtgactctaacttaaacatcatttaaaataaaatgataacattgtatgaattaccttagtattgtgataaggatcaaagataggaatatgaaaatactttgaaaatatttttttaatttaatatgttacaaaatagctgtagtatcatatttttaattgatggatggatttatccacatgaacgacatggcataatctatgcctaatactctctacccagctgggcattgttgactattcaatgtttacgaaatagatcccatccctacttgactccagaagtgctattttctaagtacatgttgaaaagtataatttcaatcagtcaagaatccagtaatgtataaaagatatttgactcagcttaaaataactggctgggagcggtggctcatgcctgtaatcccagcactttgggaggctgaggtgggcggatcacctgagatcgggagttcaacactagcctcgccaacatcgtgaaactccatctccattaaaaatacaaaaaaattagctgggcgtggtaggggcacatgtctgcagtcccagctgcttgggaggctgaggcaggataatcaattgaacatgggaggcagaggttacagtgagccaggatcacgccactgcactccagcctgggtgacagaatgagactccatctcaaaaaaataaaataaataaaaaataattaaaatatccactagccaacagctctattagcttatgttaataactcaattaaacaataactttaagcaagtctatgtagtctatgtaggccaggcacagtgtctcatgcctgtgatcccactgctttggaaggatcaagtttgatgctgcagtgagctatgatcacgccactgctctccagcctgggcaacatagtgagaccccatctctacaaataataaacttgttttttgttattgttatacttaacaaatagagcattcaaagcaaacagtgctaaccaacagaagcaagaacaagcagaatgctgcaggggccctgctcctgtgtagtcacagaccagtagcatcttcatcacctaaaaagaaatgtgttggaaatgcagagtcccaggccccacctcagctctattaaattagaatgtgtactttaagaggtcccaacttatttcatttgcacattaaattttgaaaagcagtaatgtgaaacagaacacattaggggactggaaagcttgctggtttttgttttgttttgttttctaatatacattctgaatcattttctgtaccctagtggagagccaggctgttttctttaccccgggcctctcaaacctcagacatcctgggaagcaaccccctttatactcctgtcaagttctcagttgaaatgtcgttttctaaagttaccttacatggtgagaggagcaaataaaaaaaatcaagttaaacaagactagcttccatggggattcagctcctaacttggcgattagaacccacagcaatgcttttacagaggaagatgttattgtttttaaaagagtaatcagtagggcgcctggatgtctccccttgcaacaaagacatttgcttaaggaaaggaaagtatcaggtgaaatctctctgaacagtttttttttttttaaatataataccatctgaaatcaattatcttcaaaaagcccttctaagctctaaaaatgtaaatggaataattactaattaagcattaaattaatcgtaatagcaggcatacttatttgccagatagggcaaacaaatgcaagagaaaaattataacaccagttgaaatattcttcttatgggaagacgtaacctactgttgaggattgcagaagtgcaatgaggtgaaaatcgtgtatgcacagagaattggaggttctcatccatccaacaacagaattgcctgtgaattctggattcccatgatagacctctgagtgtgaggcttgggaatgcaaattttgaacaggttcaccgtgatattcttatatataccaaattccagagatgtcctttgggagttcttcagacccattcaatgattctgtaacactgacataattgtaatagtaatactaagacttcatttgcctttttccactttgttaatattgaccctggaaaggtaggcaatactgctggtgcctcaggagaactcaaggcagtggtacccaactgtacttgtcattatattcttcaccacctcatacttgctataaaagcaaaaatgccagtttcacttaagaaggtcctcgatgaagcagtaaaaagcattaattttattaaatctcaacccttgagtccatgtctttttcacattcatgtgatacaatgggcagtatacacaaattatgtctcctgcttgttcaggtactatgatttcttcaagaaaaaaacattttttttcttgtttttgagatggagtctcactctgtcacccaggctggagcgcagtggcgtaatctcggctcactgcaagctctgcctcctgggttcacgccattctcctgcctcagcctcccgagtagctgagactacaggtgcccaccaccacgcctggctaatttttttgtatttttagtagagacagggttttaccgtgttagccaggatggcctcaatttcctgacctggtgattctcccacctgggcttcccaaagtgctgggattacaggtgtgagccactgcgcccggccagaaaagaatatttctgtgattgcttgaactgaatgctaaactagccacatttttcatgaggtacctttttgttaattcttgaaagaatgactaacgaactgtggtcattcagatttgtatatgtggaaaacattttttttttttgagaataaacgaagtctctctgtcactgtaaagaaaactgacagtatttgttgtcaaagacataaggcagctttcaagtgaaaactagaatttggaaaacttgtatctgccactgtgaactgtaaagatcttcaataattaaaaattttaatgatgaaattggtggtgacagtagcaaatgtaatattttgatatggtacaacaagatatataaacatttggaatttttaaaataaatccatgaatatttttcaaatgaccaatgcataacgttgcaaaatcatgtaaggcaaagaatgcactcaagtgcaagacagatataaattttaacgtaaaagagtataaaaagtttactgatatttcattgcaactaaactttaggaaaccaccactctgagttttggtgtcatatgagaggagaatacccacaatgatcttaaatggctattaaaatattcctccttttttttcccaattatgtatctatgtgatactggattttctttatttcaaccaaaacaattcatgaggacagattaaacacagaaacagatatgataatccaattatcttctactaagctaggcattaaaaaagatttgcaaaatgtgaaactgtatctcttcaccctaactttattatttggggaaataaaaatatattatttatattaatatgtataggcttagtttttttgagatggagtctcgctctgttaccaggctggaatgcagtggtgtgatctcggctcactgtaacctctgactccctggttcaagcaattctcctgcctcagcctcccgagtagctgggactacaggcacaggtgccaccatgcccatctaatttttgtatttttagtggagacggggtttcaccatgttggccagaatggtctcaatctcctgacctcgtgatccacccacctcgccctcccaaagtgctgggattagaggcgtgaaccactgcgcccagccaggcttagtattgtttttaaatgaatttaaatatttgttaacatgtggctttaattccttttcttgagatggagtctcgctttgtcacccaggctacagtgcaggggtgcaatctcggctcagagcaatctctgcctcctgcgttcaagctagattcttctgcctcagcctgctgagtagctggaactacaggcatgcaccaccacacctggctaatgtttgtatttttagtacagatgggttttcaccatgttggccaggctggtcttgatctcctgacctcaagtgacccgcccaccttggcttcacaaagtgctgggattacaggcataagccaccatgcccggcttgaatttggctttaatttctaatacagtaaacattgatagacaaaacccacataaacaaaagttctttgatgccttcattaatttttaagagtgtaaaggggtcttcaaatttaaaagatcaagaacctgtgaatcatacatttttttaaaaaaaagtctattaagacccccatggttcagagtttctcaatcttggcactactgacattttgggctggataagtcttcgttgtagggggctggctgtgctgtgcattgtgggatgttcagcaggatccctgacccccactcactaactagatgccagtatcacctccgacttgtaataaacaaaaatatgtcctgacattgccagatatctcttaagggacaaattaacgctggttgagaaccactgccataggtaattaggaaaaggatgtaaaaagaaaattcacaaaaaagaaatgttaatagcataaaaatacctagaaaaatattctgccttgccagtaagccaagacatgcaaatcaaaatgacaatatgttcccatttaaatgcattaaattagtaaaagtaagcataaattataacaagccatttcagtgaagctgtggttgaactggtaggattctacaattccagtagcatttttaattgattcatcaaattggggaaaataatctggcaatggttttcaagacataaatgtttttatgacctggaagtaaaaagagcataggctcaggaatcagcattaaacttgaattttagctctgaatctcactggttatgtgatcttccttaatttatttaaatgatagcatttataagaactgaatacgataataatgcctccatcatttgttatttgagaactgcaatagacaataatgtaagtgaacttctagttaaaagcggaagaattaatgtactccatttacctcttctatctcctcactgttattgcagtgaaatgtgaaaaagcatagaaatccacaaggaaaaagaggacaggagaggggacatcagtggatgagcagttttaagaaaattctggaaacctaaaaatggtcagaggagaggtaccacatgtgatgagataaagaaagtcaaattgcaaagacatgtgagtaagaatggattttatttgccccacagatttcaagagagattctgatgttggagtagtcaagtgtggacagtgtggaagtaaaatgtggggctgaaaaggggtgtttatcaaaagtctgtacacaaaaccatcaaacctttgaacatggagagctatgtgtctgccctctaccccttaggcaggagataggaagaggatttcatttcagaatttgaatgcctccgcctccaaaagcacagcacctccagtcaactttctcaacaccttacttttaaatattggctatggaggttcactggttaggtaagcaatgcttccaacatgaaagagagcagtgaattaaaaaaaatgactctagaagaaacagagataatacaggagtcagaaaagcttcccccttctccaaaatcaaaatcatatcctgagatgtttgagaaatgattacttctataaataagaagtgaatgttataagaaaaaaaattcaaagaacagtaagtagctcaaaatgaaaaattatgactgccaaaattataaacaaatttgagaatttttttgagggagttgttctgttttgttttaggaaatagaagaaattggcagaaaagaaaaggggaaaaagagtatttaaaggcaaacctaaaatgatggagttctgtgggaggaaaaatgtatgaatagtttaataaataaactgcctgaagaaatgagaataattgtacattctataacgaattaaacaaaaaagcccacaagaagagtaattagaagtagtataacatagtagtacactccagactgtggggctagaccattatgttcaaatttcatatcggctgctactagctgcatgatcttgagcaagttagttaacctttcagtacttcagtttccccatctgtaaaatagggataacactagtttctacctggtagggttttgacgataatcaactgagttaatatacataaagaacttaaaatcttagcaagctttaaattaattatgtaataatataatacttacatattatattatactgtaaaagaagtaatataccatttggctctgaagtgacctgtttttatggaattgtaaagttggccattgtgtagttatttaacaaaaaactgtggcttaactacattggaaagaaggaagggaggtattggatgatttaagacagacaagttaccatctatcatagcaggaaataaatagataatgtctgcaatcgataactttaaaatagcacattatgtagtgacattgccaattcccagaagaaagagcaaagaattaaaatgcatttgcctctgaggcacaggactgggggagggggggttgtaaatggtggtgttgggaatggttgggctatttgattttccaactatgtgtatttgttactttgagattttttaattaaagaatgaaaaaggttaatgtatatgaattggctgtcagtgcctggcatattagagaaggcactcagtacactgtagttcaatttttttcatttcagtaattgcattcctggggatttttgctatttaaaggtacaataccaaaagaaaaacatgaataaatttgtgattgcttggttatttataacaaaaaaaactggaaatgacccaaattttcaaccatatggaaatagctaagaattacgcaaaaagctgacaaaatttcataaaccaagaacatgagtttattgtttcagatggctgtggattagctaaaactgactgcacacacacatacaaagtccctgatgtgtttagactaggaaatagaaacctgagagaaactggatgtctaaagagaggaggagatgtagtatatctctactctagacaactttctgtggcctccagagtccttaatagggggcctcgcagctacttcagtcactgggcaaggggagttttttcccaaaactgaagagtttctttttgagctgtggcatggtctttcatacttagagtttgcatcactcttcaggaagaatgcatactcacaattgatgccactaatagcaatgcttacagatatttagaagcccccccttccctggctctacagttagactcaccattagcaaagtcaagcctcacctggaagtcattccaagctgtagttcgacctccaacttacaatgtgtcagaaaacccatttcttagcagagctattgatgaaaattatatgacaacaatgaaaaaatgtaacataatgcatctgagtctgcatcagaacctacaagagctacaggtcctaagatactatgagctgagcaagccatcttctcaggatctcagttttctctactgagaacaggggattattttttctacttcagggctgtattgtgagtgtacagtcaatgaaaggatgcttggtatcctcaggttctcatctcaggttctgatctagaggaggagctcaacaaagctcagttagatgtgactttgagtgtgtatgacccactccttaggactgggcttctcagactgtacacacatgagcatctcctggaggacatgttaaaacacagattgctgggctttactcctagagtttctgatttagttggctggggacagagcctaaacacttgcatttctaaaaaagtcccaggtaatacatcagtattcgatctgggaccaaactttgagaattactgtcttacaggcacaaaataccagcttggaaaatggttgagactttggagaggaaaagcaaaggcaggacggaaaagcttaataagggttccttatctgccttggtcctgatgcctactaaatagagtagaaccttggtgtgatgtctgtaccagctccacctccttcctaagctcccttctaaggctctcccagcctccagacctgaacagagcctcccgtgtcagcttcctgaactgaaagatgactaccttttccatctgcctggagcctatgggctgaggcagaggccacctttttaggttccaagaaattatgcattcgttatggaggaaattaacacctcaaagcaaactataattaggaattcttcaattcagtttatgctttttcaattaggcactctataattttaatcatgggagcattaacatgtttctgtaatttatatacctgcagtataattaagcctgggaaacacattgctctaaacctgaatggaagtgattgtttcccttcacacttgcagtattacatgtccctgatagagagatggtgccagttgcagaggagccatttgtgagttggagaggccaatgagagaactcctggctttggaaatatgatggctgttgtagaccatgtgatgcctttgaacatctgcatcccaaagcttcaactcctattgtgactttcaaaacattcccaccattggaaactgctttggacaactattcttggaaactaatttcaattaagcaggaacagggtgtcctggcaggggagacgttatctgagagccgtgggaagcagatggctttgaattgaagaaattgaacaataggctgaaacttagcctggattgggaccaaattcctttttttgaaaaaaaacattgattcctcttcctactttttctaactctgtttctctctcataatttcagctttgccttttagccacaaagcagggcctgaatcctatgtgcaaggtagttctcttgggattctgagaagttctgcaaattcaaggaattcagaggcacactgaaagtttttgtgcttattcagactgaacctctgaactgtctgaaggttaaaaaccttcattttttctctcttcttcctgctctccccacaatagcaaattcagatttgctgactacaataaaaggaaaaagaacataatcaaaactggcccggggggacaatgcatacagattccaacccagctgagtgacgcgtgcatattgctgcagcattttggcactcaatatattttgtctgatctaagaaaatatggaactttttatagagtgaaagttggaagtggatttgtttctcccaggctgctctagccttccacaaaagaacacagatttgttcagattctgatattctgatattcagcctcatcaaacatccatcttctacctagtccccaacatccgcatagaagtgaccgtattcagatatgctgtcagcatgcaacaacacaacatgaattattttgacaccagttattgtcatcatcataggaaaacagaggtgtgtttttagcccccacgtggacagggatagagaaataagctggcagagattctagttcagcttttaggagctaaaactggttatcctcatgctgaaacacacactgagagagacatgagagatccaaaagctgtaaactcaacaggggcaacttcacagaacaaggcaaaactattgcttccctatatcacaagaatgagcaaatattggtgccatagaagagatgacttggttccctgtacaggttcctttctccatacctgaggccacccataggccacaccagtagtactcaagcgtggtccaagaccagtaggtcacctgggaaattgttcaaaatgcagattctcaggcattatcctatagtccttggggacaggcaggactctgcaggcttattagaaccccagctgattatgatgttcattaaagtttggaaaccttgggattataccacttcccacattctatatccagtggaagtgatgtggggaaattttagaagtctagctcggtagatcagaatctccacagtaagtaagcccagccataggtcccacgctgttttcaggacctatacctctgtctaagtcttcattacattgctcatctcttatgataggatccctggcctttacctctctccccaaacgcctgccaaataacctctctgaaaccaaacatgggccttgacctcttcttaccaaccttcttagggtctagagcaatgtagtaaaatagaattttctgtcatgatggaaatgccgtccagtatgtcagccactagctacttgtggccattgggtacttgagatgtggctaatgcaaccaatgaactgaagctttaattttacttaattttaactagcttaaatttaaatagccacatgtagctattaatgatagttactgtattggacagtgtaagtctaaagtctagccctcgattcttgcagttgttactgggggtgctacatcttgctctgggcatgaatacttatatgtttataaaattcttcgtaagcctatacctaagtggaaatgcactaaatagcaaaccctaagcagctgtagccaggtaagaaaagggtgaattgtattctgagagagtaaccacacatttttttggcccattggtggagactctaactttaagatgttattttcctaccaaaaagccagggctttcagaatcacttctctcactgttgccaagtggaggcaactccctgagcagccctcaacagctggagcaggcatcgtgcagaatgctttttggataagagcaaacctccttggattctaacatggcacagagccatgctctaactcagaagaacatcaatagatcaggctatagaaatgcacttgatggaagcagacttgaaagtctgacctttgggcagttgcggacagagaccgagagccatcggttatcagctgtgcaagatctgagacaaagcagcgatgcaaactctcatggggcccagaacagtgggagaagtaaaagtcagcagaaaaaaaagttagagaaaaagtaaggaccaggagaaggcatcttgcaaggtcaccgagttctttcaaggagtttcaccagttccccagggttggagggtttgtattataagaactacatctacttggactgcccctccatccttagtctggcctcgtgttccttgcaacatttggctccaatgaccttcaccttgaatctattactgtctgttcaccatcactgccaatgtggtcacaccgagagccatcatatcctatagaagagttttattactgacaccttatatttgatcatcttattctccaaatagcacttcctgtctttctacactctccctgctttgtaccctctgcacaaattcttcaacagcatccaggttgcctggccctcaatatatctattttctgaacagcaaccttcacattctttttaaagcaagcctacaccagatggtccattttccagcacttttgttgacattatccatcatcttcatttctctgtagtcctggatcaacttgtgtgtctttcttcttttctactacaagagcttcttgaagctcctggagaagattaaacgattaaaaaaaaattaaacgattcttcctttgaatttcttgttttaaaagaaaagaaaagtcaaaatgaaatatacagccctggttttccttctacctctttggccagtccttctccatctcctgtgtgtttccttgataaagtttcgtagctctctgttctgtttctcatctcttctaatctacactctcccaggatgaggtcatccactcccctccatacttgaaataccacctggatgctaatgactcccaaatctaaaacccctgctcagatgcctctccagcactccagacttttggaatttaaatagtccctatggtaggaggtgagcatgacaaccactcttctttccctcatgccagtaacagtccctgtctccatctctccagatggcagacagtccaaaatagaacactctttcgatcttcatgttccatcgactgctccatttaaaatattcttccccaaacacctgtttttcctccttggttggagcctaagtaatataatccagaatcctaacaccagagccaattcttggtaagctgagttgttggtggaggaaggagccttataaaaggggacctgaaatgcagtcagggtaaaagctgaagtgaatgcaaacccacctacattatttgggtgtcacctttcttcccttttgttttcctgaacaatcatctaattgcagctctgtgctatatcaccagactgacctttgtctcctagggtgatgtctttggtggtacacacataacccttcaatatgtatcccaatggttggcatatgtagactgtgggacaacctcatggagaagggcactacagtaacattcatcccttattctttatttctggttacctcttcatatatctggcttctcctatttcccaatctggtgtgatgaagtcccagcgtgattttaggcatggctaaaagtggtgttaacaaagctacgtcttctcccaggttatgtctgggtatctcttatccatgtccccctaacccccaatacaccaaagtgggacccatagcattcctcatcatcaggtcccagcaaaggtggcccagagaactggggaactaagtgaataaatgaggtttggagaaagagtgtctaaatgtaattacagtttctcatctttcccaatgtggacaaggcctcacaaactcctcaggctgccctgtgtcaataaatcctctaaatgttcgtttctctttcctaattggacaccatcatatgctggtatctgagaatcagacggtaatgattccaattttgctcactgcggcttcatggaccagcaaaacccctctgtgattgtttcatgtgctcccactctgggcttcacagttattaaaggaatcctgaaggaaatctggcaatcgtttgcttttcttcccaataaagtttcttctttctttaaaagtaggctgtatctccaattggtactgtagctaatcactgtgcagttcagaatctatggtcttaactaactgcacctgtcaaatgcaaaaggatcacagattctcatcaggaggtgaagagaacttgcaatgacctttagaagtatatatcttgttacactgtcttctagggttccatctttcatacccctggtcctccaggctagagttcccacaccctgtgcaccatgcctcaagcaacctaagaaagcaggtctcatgtcctaactgaccttgtaaaaggtcccttagaagtcccccacactctcctagaccacacgccaggttgcagctgtccttgctcagctgagttcctaactcccccattcagttcccagaccacctttgccaccattcgcctttcctggatgaaatgtcctcatagactcttccctccctcggcatctattggctcagagaatggcaccactttccatcccacgaaccaagccagaaaactgggagtcatgctggacaatgtcttttccttcacaccccaacaccctgccccttggagaagtcatcacaagccatgtccattttacctcttacaagttgtatctcatcgtcataagtactctagtggtgggtcaccttcatttcttatctgaacaatgtaactgtctcccaagggtgttgctcttaaccccgactgtgctggccctttggcaatgagatactacaagcttgtctgcttgaatttatatttcggaaaggtgctcatatctgaccaagttcacagactcataggcactttctttttctgattgtctttcctatttttaaggtaatgttgttttgaagatcacccctggagatgagtgtaggtttcctgatgtgccctacactggccagcacttcgcatgtagtagatctcacatgagtgctggaggatacacagcagataggcattggcttgcagcagggctcagagaaaattcttgcccatggctgcccatggcttagagccactctttgcctcaacagcttggccaaacacaaggactatgtttctgttttgttttgagacggagtctcgctctgtcacccaggctggagtgcagtggtgtgatctcagctcactgcaacctctgcctactgggttcaagtgattctagtgcctcagcctctcaactagctggaattacaggtacctgccaccacacccaacgcatttttgtatttttcatagagatgggtttacaccatgttggccaggctggttttgaattcctgtcctcaggtgatctgcctgccttagcctcccaaagtgctgggattacagacatgaggcatcaggcccagcccccaaagagcatgttgaacaattaccagttgcaatttacacagtttagcttattcgaccttcaaaacaatctgtgatgtaggtattcccatttatcgacaagcaacttacggttcagagaaaataagtacctgcttccagtatacccagtgggacaattggataagactggtctgattttaggagccactcctgtttcagtgtatccaactgggaagtcagctatggcaggaagagcataatggtcttaggtctgagtgaggagctccgtatgggacccatctctgccctcagggaggccacagtctagcagaggctgacaacgcaaggcactgacagagggatgaccatgacagagtggcaactcagaaggagctggtgcattctgctgcaagagtggagatggtcctggatgtggccagtgtgaaccggatgttggagaggtggagaatggcatgcttggtggagagaacagcatggactaggggcctgtttgctcagagaaggacaaacagttgggcactcaccttcccaatgttccacactcccttctgaacaaagtctaaatccagagtgaagaccttcttcacctggaccctgcctgctcctttgcttctctcctcatctctctgtccccacgcactgagctacttgtggctccccaaacacaccctgtaccttctctgtgtgcgcttttgcataggctgctctttcttctaggttacactcttcccttcttcactaactcctcctcattccctaggtctcaatttaagcaacactgcctccaggaagccctcccagcttctgagctcaccattctaccaagggctgcctctctactgaactctcatggaaacttctgaacaagctggccaaacacaggctcattggcaccttttctttttctgattgtctttcctgtagacctttaccatccaaaatggcagtcagtagccacatatggctcctgaaatttaaattaattaaaataaaaattttaaacatcagtttcctagttgtactagccatatatctggtgctcaatggccatatgtgttcagtggcagtcataccacacagcacacatataggacatttctgtaactgcagaaaattctattgaacagcactcttttcagaataagaggtagctgaaggcatatatacacacacacacacacacacacacacatatatatataaaactagttactatagatatacatatatatataaaactagttactatagatatacatatatatataaaactagttactatagatatacacatatatataaaactagttactatagatatacatatatatataaaactagttactatacacacacacacatatatatacatacatatatatgtgtgtgtgtgtgtgtgtgtgtgtgtgtgtgtgtgtatatatatgtatgatgccagacactatcccatgtaaagggaattcagtagtaccaagccttcagatttcttggagctcacagcctatagaggggtatgtagaaacaacagaaaacaaaacaaaaaatatatatatatgaacagctgtataacacaattaaaggctcaggaaagaactatgaaggaactatataggtcactgttgagtaaaacctggtaaaggggcagacggaaatgaaaggaaaccggaaacaaggctaaggacagattctgatgagccttgaattccatgctaagaagcctgtacttaatgcaatggaaaaccaatgacccatttaagaattttaagcaggaaagttaacttgatccaatttgtgcttccaaaggatcactccagcagttcagtggggggtggattgaaggatgagaagctgcagcaagcactccagcaagcatatcctggcgggtgcaggtccacaggatgaggctggaaagtgccaatgtgggagaagaagagagagcttggcccaggttctgaagtccagaggaccagtctccatgactaattagatgggaaggggaggaatgagggggaaagaacatttccaaggaagtcttcagggatcaggggacggtctgttatagaacctggggctctgcccccagcctcacttcagggactgcattataggtgactaattcatggctaagttactttcttatgaaggttagtacggatcagtcacacatcagtgtgacaggtggggcgtgggggaagaaggctcggcatgttcaagccagaactgaatattagattctagtcactatttgattgatcttttaagcaattctgggattctgtcacttaaaaaccaataaatctttgaaggcctgaggaaagcaatacaaaagcaataaatctccattgtggagtgttagaaaaataggccaagctgctgaggtggtttggctggagggatgagggtgcgggagccccacacagcaacagtcctccctgtcacatctcgcccccctgcacactcagttctaccagatagagtcagatccacagggcttcagaggagcagtaagtggcaaagcaggggctagagtttggctcagccagggttggagcatcactggcagaaagaagagcctgcctgagtggggtctgaaggccaaagtttctgtgtgagtctgtttgagaacacacagctccactcaaagagggacccactgaagctcacaagtgatagaccgggctcacacaaggcagagttggaggacccctgagaattcctcttgcccacccctcatgccctggttggtggaggtttactccgtagcacccccacaaaagggccacccggtcatcacgtgacataccaggcagaggaactcagaacttcccaggggagccatgaactcagagccaggatactaggtctatgcactgtctttaactgtaacaagccccacaagcttgggccaatcagttaacatcttagacttcagtttcctgctccaaaatggagatggtatttcccaaccagctgactcaccaggtaggtgaggatcagataatacaatggaagtaaaggaacaattcagaaaactaattcagaaaactattaactgtaaaatttattcgaagcatccttaacccagtgcatctagtgagttctttgagtcctgggatcatagagtgtccatattgttttctccatccttcacctccccaactcacacaactgcacactgctctgctttcctgggtggtgctcatctgtccagccagtctaccgcttctctcaatcactacagtcaatgtacctagtggtttcatatcatcttacagtggaactgcagaagcagctcaatacccctgggttgcaagaaacataagccgagcacaccagatgcaccaggcatgacaccattggtgggacctaggtgcttggactaaggaatggggatagtttaataagtgaacaccacatggcatgatccatgattcaatagcatcacctcatgacatgatccagtcagatcaagtctcccacatcacgacattgcaaatgtccaatcagatcactccattaccttctgcctataaaacctgtccccgcctccaaaagcctgactcctgtctccttgttcagcagccttgcaataaacttttctctctacaaaaacacagtacttcagagtttggctttctattgtgcatgggcaaacagaccaagttctgttcagtgacactttttttgctaatttcatgattttgtttgtttgtgtgtttgcttaatgtcccacctccctgcctcactcacaaacaatttactggagcctcaagaggacagaggtgtggctatcttgttccttactgtatccctattgcttagctcacttccctaaacatactaagtgttcaataaatatttgttgcatgacctagtggtcaactacctctcatataacatcctactgcccagagttcaaggtgaatgaaggtcaagataactgaaatccattgtgatatttccacttctgtccttccagttgtcctgaaattcgtgctgggtggcattggttagtcacttccccttctagtcaaatgctcaagaaacagtctggaaataattccagaaactgagtctacacccaccctcaatgctctagagccttgagaggaaaagcagccagacatttccagacaccaaccatttcccctttgagcagtgacatttcttttatttatttatttatttatttatttatttatttttggataaaaatgtcaccaaaatatatcatgcacacctttctcctaggaggtggtatagtatagtaaaatgagtgttggctttaggtcatttgaactaagtttaaattttgcctgtaccgtttgctggctttatagcctgagtcaactgacttagcttctgtttgtctcaatttctatatttgcaaaatgaggagactattatacaatgttgcgagaatacaggtagtgttatatatagagacaagctggtagcaagtgcttgttccttaaatgaaagctagcaggctcctgtaagttgcagacccatcttttcagggtaaaccaggaccaagtaataaacacgaatggctatgagggatgacagcatgtaggcctgcttgatttttgagtccctgtgtctgttttgtagagttgcgctattcctttgcaccctgacaactgtcatttctcattgctactgggaaactttcatccccttatccctcctcataatttgttgagtcttacgatatataagcttgttaagtagacatgcaaaaccaagagtatagagattcagagggaaagtgtaaagacttctctgacttagggggagcattgtccaaagacttcagactacataggaacttctaaattggtggtggttggttctgtctatttcaatgcctatcatttctagatgaagctggatacaggatagacaatggctagctagaccatctcaaaagcccccttctgggctggtgtcctagcctccagtgacacaaggagtgaggctgcatgcatctctctagtagctgcccatgtccttcaaacaggcctgagcctctcaaacacactcccattctcatcccagcactcccaccttgatgtttatgttaaagcaacaaccgccctggttgctccctgttatagcatgctgtctctctcctccatgcctgtgctcacactggacactcttacaacgttggtgaaatcttaagcatcatttaagatacagctcagtgtccccactgggaattctctcctctgagctcttatgcgtatctccacaacgacacactgtactgtaattatgtttctgtctccccaactagagtttgactttctttaggatgtgacttatccatggctagttcactgctgtgtttccaagcacttaagcattgcccgagacagggtggattcttaaaaaaaaatgtttgttgaatgaatgaatgaatggtttttaggccttgggccccgcctcattcctggtacataacatactgagtttatgcttgatgaattgaactgagcaatttgaaagttgttccactcaatgctctgcttcattttaagggactgtagtcctccttcctggagttctgggcaaaaccggcagtcaatattgctgcccttgtgcaaagtgtatcttgtttaaaagagatgcccacgctcctgatatcatgaactagcagtggtcagtttaactatggagatgcgtcagtgtattcctgatctccaaccacgtttggtaaaatcagcagttttaccttgacagcaagtgcccctatgggactccagcaccctacagccttaaactggaccagtccccaggtcttgtcagatttgtgatatctgagcaggttgttttcagtattcagcaaacctgtctatctggctgttactggcagtgacacaaagaaaagtgacctttccaggagactgtgttccaggccaccgaccccactaactaaatttaccataaacatgttccaggaagtttccttctagaccatctcaggtcctgattaggatgtttcttgttttttttttttttttttttttttttttttttgagacagggtctcactttgttgcccaggctggagtgcagtggcatgatcacagttcactacactcttggtcttccaggcccaagcaatctttccatatcatcctctcgagtagccggtactacaggcgtgtgctaccacatccagctaatttaaaaaatttttttctttgtatagacggggtctccctatgtcacccaggtttgccttgaactcaggggctccctttgaactgggcttggggctgctgacctccttcctccgaggaagctttgttcctggccagtcttgcccatgggcattgccagtcacatgattcaactggaggcccatgtggcacagagaagaaaaactgcagactccaagtgaagaaccatcctcacctgacaggagctccccgggactgagcgggtttcagcatcactgtgatggtcgtgtctgtctcattcaatggggtgtctgtgtcgtactcaggcatggatggagctggacaggaaacagagagtgcaggtgagttcagcacagattcccaactggctccccaccgccccttgctgccatccttaaagacacagcatggatagagggaggacgtttaggaaaggggttggataagaagccttccaggccttcagtaaaggaggccccgatgcccaacctgcccatagtaggtttcttcaaggtgcagtagtgtggggaagggtagcaatgatctgtcgagtaacctgcatgaaccaaaacgttccacacctaataaacagatatgtgcagggaatataagtactaacaaagaagtgaaagcagagtcaaccttgccaaacacatttaaaatgcaaattacatcaattatgaactacttcccctctaccttttttttttttccttcatgagacctcccttccctcatactcagctgataggaatgcgactatatctattcctttgggaaggtaatttagccatttgtagtaacagctattaaaacccacatcctttttaattcagtttttccaaattctgaatttattcctaaagctataatccaaaccaatgaattaaactttattttgtaacatgtttattgaagcgttattttgtaaaaacacggaagcaccaaatatatccaaccacaggggaatgtataattaaattacgtccatccacttgacagaacattataacgaaagcaatgtagcaacataggaaacacttatgggataaagataagagaaaacattaagctacaaaaaaaacatgtttttctggaaaaccatgtgcaaaatatgtatgtatgcagaccagaattgcatacatatttaggataatgaaagctgtaaaaaaggttctgaaataattctgcattgttgctgtctagtggcagagggggccctacgggtgatggcagtctgtaattttggactactgtggccctataatagtaattcattcattcattcattcattcattcattcatcaggtatttcatgagaacctgcgctaatgtcttgttctggcaaaaagaatgttcctgaaaatgaatttaataaccaacttgtgtgcaatatacattatctacacacacgtgtactatttaatgcaagcctgtgggaaaattatttagtggcttgccacctaattaatctaatttttacactttaggaagttcatcacttagattttcttcataggagacaacaatggtaactcactagggactggatcgtcctaattccacccatatcacagggtgacaattcaagaaaaatttccacttcaaggaaaatcaggaagtgggggtgaaacaaccttttttcctttttcctttctagcagagatacctgaaattttggtggcaatccgagtggtgacagggggcccaaagccctttgctgtgctggccttgatggtgaaggaataggtggtccctgggtacagacccacaaagaggtggtgggtttcattccggagcttgaacactttccccctctggctcgagaggtcagcacttgggtccagcgagccgacagccttgtagttgatctgtaggacaagccagcaaacaaacaaacaaataaatgcctcactcaggaagctggatggagctcctttagaggaaccttagggaggcgggggaaggggcaggcatgtgaacttggccagcagattctgctaagctgcctgttgctgtccactttccagatgatcccagcctccaaataccccattgctcacccactggagcaatgcatgttctcattgatttgtaggagttaaaacttaaaataattgaacttacagagatagagagtagaaggatggttatcagaggctgggaagggcagtaccgggtggggggatggttaatgggtagaaaaaattgaaataatgaataagatcttacatttgctagcacaacaggcggtctatggtcaaaaataatttaactgtacattttaaaataactaaaagggtataattggattgtttctaacagagaagataattgcttgaggggatggacaccccatctatcgagatatgattattacgcattgcatgcttatgtcaaaatacctcgtgtaacccataaatatatatacacctactatgtacccacaaaaaatttttaaaaaaagaaacagagggcgacccacagatgtcattttgaattttctgacagtctcatgaaaagaagtaaaaaaaaaagaaactaattttaacaacacatcttgttgaacccagtgtatccaaactattatcatttcaatctgtagacaacataaaaattgaatggaattgtttacattctactattcgtatgaagtcttacaaatatgtcttttaccccttcagcgcttcttcatttggactagccactgcttttcataagtgcagtagccccgtgaggccagtggtcaccatgctggacactgcagtcatagaacagtgtccaggtagagcgtcccgatgagaattatttataagtcttgttaaaaatgcagatcccaggccccatattccagacagatagcgattgctgactggtgctttctcgtgcattatcttttttgtcttcctcaaatccttgggggcatcaggatagctactctcattttaataatggagaaactgaggtgccaatggaagcaacttgcatgcaatcaccatttttcaaattgtatatggagatagtttgtctatggtatatgaagaccatgccccatgtgacatatcatgtgagttcagcaataaccaaactggtctacacctgtggaatgatttgtgtctactgttccctgatcacacacttgagtgtcacagcaaggtactagaagagttttgaagcactcactctcaacttctgcacttgcccaagggtgaaaataacaattggtagcccagcactggtcccacggatcacactttgagtgtcacatcttgaaattacacagttgtgaagtggcaaacacaagattttttgtttgtcttacctggtttgttccattaaaaatatttaattaggctaggtgtggtggctcacacctgaaatcccagcaatttaggaggccaaggtgagaggattgctagaaccaggagtttgagaccagtctgggcaacacagtaggactctgtatctatgtatctacaaagtattaaaaaattagctgggttggtggtacacatctgtagtcccagctattcaggggctgaggtgggaagatggcttgagcccaggagttcaaggctatagtgagccatgattgtaccactgcactttagcctgggtgagagagagagaccctgtctctaaaaaattaaaaaaaaaattaattatggtataatatacatacagaaaagcataactcttgatgaatttttgaaaactggatacagtcatataatcaaaaaccaaaccattaccaggcccaaaacgttttcctcacactcccttgcaatcctacttgcctacccccatcagggatcacctctgtgtgacttttaacagcatagacgagttttgccagtttttgcactgtgtatcagtgaaatcctatgaaacgcgcttttttgtttctggtttctttctctcaacattatcattatgtccatgggattcatccatgttgtcatgggtagtagcaaataaggcattcccaggtacattcaacaatctcttgcagacaccgtactaggcaggtctgactccaaagcctgtactctatattctataccacattgcctggcctgttaacagtgcatcagttgaaaaatgaattcactcatccacttatttgctccttcacagtgtttcctgtgtactcctgtgttctaggccctgcactgtgtgctgctggagaggtgcccaactgaattcaagtcaggcctcatcctcaagtgacttccattcttgagagaggtaagccagctatatacacagctgacatcacttatcttccatcaagaatggccaaacccaggcagaaaaggaagcacaccaacttcccttcaaaaataagcaatttgctgttactggcaatggcaccaagtgttttggagagaaaagtgatttctctgtcctatattaaacagtagtggtgccgcatccttgaggagagaggtcagacggtgcccagagcagagtgtgcgcaggagggaggaaaaatgcagggagctgagggctttgggctttttttcaagcagcacctgagtgtgcatgtgcaccatgcaggtggctgctagcttcaggctgctctggtgggcctgtctacagcattccctctggtcacccctacccaccccactccttctcagaggcaagtgctacaggcatctatctgcctctctgtttgaggactttctccatgggtgcttgctgggaatgggggttaattaacaccccagccctgatgggagttgatgcatacattctccaggctccccttccttatacccctgcaagctccccctccttggtattcctgcagcatcccaatttccctgagaggctcagctccacttgcctctagaggcagctggtttgaaaacacagtgatgattggctactttcctttctcttccccactccatatctctttactggtgtttcttaaacttcttggcaaactgctcatattcaaatccccatctcagggtctgcatctgagaatgaccaaactaaggaaaaatgctcgtggaggtatctcaggagagagtgcaactgacatccgaaggacaatcctgagtcagaagaggaaagagtattctagcttctaggcagagggaaccgcgtaggcaaagatctgggatgggaaaaggtttggacagagcaaagcccagagccactgcagagcagtgagcaaatgggggcaaatggagttttcagcatgcaggtggattctggtttccactgtggcagaaaaggggagatgtacagacagttcagcctgtagccaccaaccccagtgcaccagtggagaggacgtgtgcttgcattctttgaaaattctgtccccgtccccctgcttggactggtggcaactacattgatatacagacactgggaggtaaaactcatgccttatttactagccaattcctttcctgcgctccaaattcaatccaaaagcaactcaatttccaccgagctgtcaatataatataccgcgctcttctgctctcctaacctttcctggtattacaggatcctcacttacttgtaatgaaacactatgaataaatcaatgtatgttaatatagcatgtcttcaattttttatgaagggcttcaccaaatctaattcccactgctttgtcagaaacagtctttgaaaaatttaacttgcaagtttcacgaagttagtgagggatcgggctggggagggaaagaagaaaggtgagaaaaatgggatgggagggagctgtggctgtaaacgtataatataatatgaaccttcatttataagcggggaaaacggaagatttgtagaatagcaaacataaaataaagggttagtagggggaagggtacacagctgcacatcaaccctgggctcctggcatgggttctggctgcaaaaagtactcaaggatgtcccccttctcttttagttgctgacagtaggatccacagccagaaaccaaagcaggtgcttcataacaaaaatcccaggctgagcacagtggctcgcacctgtaatcccagcactctgggaggctgaggcaggtggatcacctgaggtcgggagttcgagaccagcctgaccaacacagagaaaccccgtctctattaaaattacaaaaaattatccaggtgtggtggtgcatgcctgtaaccccagctactcgggaggctgaggcaggagaatcacttgaacctgggaggtggaggtagcagtgagcagagatggcgctactgcactccaacctggtcaacaagagtgaaactccctctcaacaacaacaacaatgacaaaatccaatcatgtcgtaagagcaatgctttcccagagctctcaggatgaagaatgtgtctctgtcatgtggtcttaatcagctcagtgcgtgagctggcctcgctcgtcctccccccagcaccccaagccttacttcagtactaaaaagagccatggtcttttctgccacaggaacttgcaccagctcttctgtcagcctgggccccgtcttccttcccatgcctccttgttgcctcattcatgactcctcacccttagcggacctcacttacagggactctttttatgggtatcttctctgactcccaggttcttattttacgtttccagagtcacctgtctctcttttgagccactaactttccatgtaaccatgtaattatttcatcaataagtcccttttctaccagcccaggagctgaaaaaatatgacttgcaagtcaaattcaatctaccatctgtttttgtaagtaaagttttattggaaaacagctacaccattgatttaaatatggacttatggctactctcacactacgaaagcagagagaagtagcaacagataccctacagcccacgctgcctaaaatatttattttctggcctttcatagaaaaagtttgcagacctctgtactagactttaagctccaaggaggcaaagatcgtatctggtgtttgttcaacatttcatccttttgcatgtctaaatgaataattaaattagctgtgtagcttgagggattgcttaacctctctgagcctcgagttcttcaagggaaaaattataattctaattttagtttccattttatgttgcagagtgacccccatttctttactcctggaagacaagccattgttttggaaggaaggctccagaatgtccatgagtggctttggcttctgtatcaaggcgcagtggctcatgtctgaaatcccagcactttgggaggctaaggcaggaggattatttgagcctaggagtttaagagcagcctgggcaaaacagcgagaccccatctctacaccaatttgttttaaaaaactagctgggcatggtgatgcacgcctgtagtcctagttacttgggaggctgaggcaggaggatcacttgagccctggaggtcgaggctgcagtgagccacaatcgcggcacagcattctagcctgggaaacagagtgagaccatgtctcaaagcaagcaagcaaacaaacaaacaaaacaaaaaagtttgaaggtcatagaaaagcaaagaaagaccaagaaatggtcacaggttgaggaacaaggagacatgacaacgaaatgctatgtgagagcctagaagaaaaaagaagacctctgtggaaaacctggagaaatctggaaaaaaaaaaaagtctggcatttaatcaataataatgcactgaagtgaattcttaattttaataaatataccatggctatgcaagatgttaacattagggaaagttgtatgaggggtataaaactctctctttttttttttttacagtttctctgtaaacttatttcaaaatcaattgtttaaaagacaacaaatggcatgctgagatttggctgctgtgagcatctttgtggctgcagaacagaacctaaacagatatccattgagctcttgactaggtgcttggccatgtactaagctctagagaatcctcaggaacctacaatttggtgagggagataggtatggcccacaggaataagcgggcaaggcacattaagagctctgttctgaaggaagggaagatggctcttatgagcatgtaacagagaaaacagattgagtctctggggccagatgccttcctcatagagtgtgaagctgttaaccagatgaggagcatgggagaagggtgggaggcatgacaggagatggtggagaatgaaagaagaaaaggctcttgggcaggacaactgcttgcctaagggatgcttttgtgcaaagtagaaaaggtgcctgtctcaactcagtctcagccccctgtacttcagtgagctgatgctgcctttgtgagaagaagaagatacgcttttcttggtgcccagtcatattcttcctggcagacacagcacagagtttaatggatttcatttccttggtagtgtgtctttgtgcagtgcacaaactaagcaacagtaggtggcatttctgctgagctcagattatggaagcctttaatgaactactcaagtgtatatattttatttcgagggtaatatagagccattaaaggagagggtaggccatcaagagagacacaggatcataccacagtgctactaaacgtgtggtttgcagataaacagcatcagcaccacctgggagcttgttagagctgcagattcatgagtctatcccagacctcctgatcagaatgtccggggctgaggcccagcactctgttgtttcataagctctccaggtgattctcatgcacactgagtttggagaaacactttctcaggcaaggggatggaggattgaaatgaccagaggaacaacaccggggtccctttggagggtctggctctcatgcagatgacaaatacaaagaaggccttgtttcaaccagaagcagaggagatggagaggtgacaacagtgactctgagagattctgagtcctggctggagaagaatgaggtccctagaaatgtaagaatgagacggagccaacacatggccccagacctgagcctcctaaggctgaaaaccactggggaagacctgcaagtatccttactggcctcgtgcttccaatgctgttaacattcatgaaggcaaagagtgtgggtctcagccagcgggagggaagaccactggctgacagtcttgcagagccagggctgaaactctgacccatcacttaccaagctttaagcgactgaagctctattttgtaccctcaccagccgaagggccctggagacaacagaacagagcagcaacgcctctgaacagcatctgccaggcttccctgctttccaaagccaagcttcagggtcagaggctcagcctgcaggcttggttggctgtgccggggcctgcccgggctgcacaccttccccagcactgccagcacagggacccatgcccgtggttcctggccgtatcagccctgctgcggccctgcaggggcttcctctagcctggtgcggactttcttggttaccatggatcaaagggctgttgtaggagtggggaagttaactcgtttgcccaacatggcttttgctgatttccaatcaatgccctgctctctgacttcagctgttttcctattggctgtgggatcaaacatagggagaaaacaaactcgaaatccagctggcccagggtccttagtattcaccatccatcaaccaaaatggagggttagttagtgggtgataataacaggaacaaacattatgtgcctaccatgcatatggctctcttccctgtgtcaccatcctgctccttagctaccagacacactttaggtgagtgtattcctgtcaacaggtgctccctccaccaacacctctggcccctccaatccttagcaccgggctgcttcccagactcattgccttccctcccctgcctcacatgagagggatattctgagattcactcttcccagctgccctaaatttcaaagaatgcagtcagagtcccatagcagggccaccatcaactcagacggctctaagctctttcttcctgaactaccataatgcagcctaataatatgaagcctcaacctcctttcagcttttagtctcatgctggggtgtcctgggtgctatgattttgttattttcacagaaaccttcttgtttaatgagtctgtctagcaatattcccaatggcttttagtctgtattgcaatacttcttgggtttctgaacatgagctgcttgccttccaacttcacactcagctgatttctgttctgctaagtttaacctggttaagttgctaagttgcatgaccaattcctctccagttggctttgggcatggagatgcaagaagttaaataatcccatgatcctgctcattggaaccctgcagccatactaacagcctttctggcagacaccgcctggaacaaatccttcattaagggcaaagcctagattctatttattgattgtaataattgccaagcacccagcttggcatagagaaggagtcaataaggtttaccaaatacatgaggattaagaatgaaaatgtaacaaatcctcaatgtggtacaactgggatttaaaatgaggtcattctgatcctgaagtccagtattctccgccccaccctgccaccttggccttggctcctctgtgcacatcctgtgtgaacagtttctagggagaggggctgattgaggggaggctgcaactgtcagaacacgaggctttgtagagggtctgtctgagcccaccccactcaggagggacttgccaagcaagcccagaagctgggtccatgcctgtccggcacagagttggtgctcagtaactatgtatttaataattaaggaggcccaaggtggtgaaggtcttgtatctgggcctgaatttctaaacctgtgtaagtagaaagtccttttggtgctttttagaaaatagcccatatcctttgacactgctttcattaaaaggtggtgtttatatcccctgactccccttaagtcttaggggacttgggactgctctcaccgatacaatgtaggggatgtgatattttgtgacttctaagattaggtcatgaaggcaatgtagtttctgacttgtccacagagactcttatgtctacagtgtctaagctgctgtataagaagtctaactcccctggggccgccatgtgtgagcaaacgcagggtgcatgacagtccctgtgtagatgctctagattgacagccccagctgagtccagtcatctgggcaacagacagctaagtgaggaggctgccgtgtgagtccagttctcggctctctggtcacccctggtcatttgagtcttctcagctgggaccctagacattgtggagctgaagcaaatcatccctgccctcttgcattcctgacccacagaatatgtaagcataataaagttgttgttttattccactaaattttggagtgatttgttaccagcagtagtaactagaacaccatttgttcattagacaagagtttcttaaagagcatcggcaatattttattctctttcatatccccaaaaggaaacagtaaatgcttaacaaatacatgctacattcttagccaaatgatgaatgtcaacaataccagtaatgagaaatatggacattcaggctgggcatcatagccagactccatctccacaaaaaattttttttaaaaaatagccaggcatggtggtgcatgcctgtagtcccagctactcgggaggctgaggctgggaggattgcgtgagccagggaggtcgaggctgcggttaggcaagactggtccactgcactccagcttcggtgacagagtgagaccctgtctctaaaaaacaaaagtaaaaaataaaaataaaaataaatatgtacatcatatgcctcttgatacgatgctctgagaaagggttatgtgtggtattttttgccaaaaatgcataatctcgatctaatcgtgagaaaacatcagaaagaaaaaaaaaactaacttaaaggacagtctacaaaataactgaccagtattcttcagaagtgtcaaggtcataaaatattaaaaaaataataaagactgaaaggctgaggagatgtcccagactggaggagactaaggaaaaaatgacaagtaagtgaaacacggataggatcctggactggaaaacgacattagtgggaagataagtgaaattcaaataaggcctgtagattatagtgttcattataatgtagcttaaagtatctatcaatgttaatttcctggtttcagtcactatcctgtggttatacaagatgctaacataaggggaagccaggtgatgggtatatagaaactccatactaatcttgcaacttttctgtaagtctaaaattattttaaaattaaatattgagccaggcgcggtggctcacgcctgtaatcctagcactttgggaggccaagggggacggatcatctggggtcaggagttcgagaccagcctggtcaacatggtgaaaccccgtctccaataaaaatacaaaagttagctaagcatggtggcgggcgcgggtaatcctagctacttgaggctgaggcaggagaatcacttgaatgcaggaggcagagactgcagtgagctgagatcacaccactgcactccagcctgggcgacagagcaagactccatttcagaaaaaaaaaaaaaaaaaaaaagaactaaatattttttttaaaaaaaagaacaaaaaatgtgcactaagtctcattgattggcaaatctgtaatcatggacccacaagttagaagccaaaggcacacccctccacccctcacattcttgcagcaatttattacaattatatatatatatatatatatatatatatattttttttttttttttttttttttttgagatggagttttcgctgttgtcgctcaggctggagtgcagtggtgtgatcttggctcaccgcaacctccgcctcccgggtacaagcaattctcctgcctcagcctcccgagtaagtgggattacaggcatgcacctccacccctggctaattttgtatttttagtagagacggggtttctccatgttggtcaggctggtttcaaactcctgacctcaggtgatcagcccgcctcggcctcccaaagtgctaggattacagccatgagtcaccgtgcccggcctattacaataatattaacaacacgagaggacatttaataccactcactagttgccaggtgccttgccaagcactttccacacattactcgtttaatcatcccacaagtttatgaggctactaccgttactattcccactttgcggatgagaaaactgagacttaaggggagcaacttcccagtgtcttcacagataggaagaggcagaggcaggcttggaaccccggcagtatgaatctagaatccacctgcttaaccttggagctcttttgtcatcatgaagagtggccagtcttacttccagggcctgggagaccaaaaacttttgctggaaatctcttaaaggatcagctagagtgcaaagacatgttaggagtatttggacaggcagagagagcttttgagtgcatcgttgggggcacagaggccaaaattaaggtgaaatggggtggaaataaatctggagaattaggggcgatcaggggacttgatgctagaatgcatttccaagcaccccagaggggttttctgaccacctgggaacttcctgcatcattgtcagaggccaagtcagggatcaggttgagaggcccttctaaggagaaatccatcgatcacgtaatcacacattctgggccagtgcggggctgaaggctgaagtttcactctattgcacttttctttcattcagcatttttctcatgaaattaaaatagaattgattttctcccccactaaattaggcattaggaaaggaacgaaagggagggcatgttggagactacaccatcaattcaatccagcagagtagcatttgtaagaaattgtattcgcccctacttactatgagaaggttttgtaaagcctatttttttttgttatatctccttcttactagaagagatgaacatttttttttctcccttcttggttaaaacgatcatttatactaaccttttctccaaccctctggcctcaggttagaagcttcctttttctaactttgcctctgtggtatttccccagaagcagacacacagcaggtgacactgctgtttatggaactgtcatttctgatgaaatgggtcatctggggactctacgttctcctattctgcagtgaccccaggctcatagctgggtccagagtggaacctcacagctggaaggaactactccatttacagagtgctgaaaggagatgggagcaggaggaaactgaggctcagagaggttaggaagcacacctaaggccccacagtaactggttctactcgaaggaggcagcgatgggataacaaaggagtcagaaaccttgggtacaaatcctgatgcttcctcttagcagatggtcatttatagctgcactgcccattagaaataggatgtgagccacatttgtgattttatattttctaggagccacatggggaaaaaaggcaaagagaagcaggtgggaattaatttcagtaatatactttctttaacccaaggtatccacaatgctattattccaacatgtattcaacacaaaattattgaggatattttacattctcttttcccactaagtgttcgaaacctgttgtgtattttatattctgaacatttctattccggctagccacattttgagtgtttaatagccacttgtagctagtagctagaccagggtttctcaatcatttttttctttactatcacctcctaagaaatgtatttagactttctgtgttgtacccctatgaattttaactctacagatgtggtgtatagttgtatatggacgctatgcatacctgcatggctgtatgtgggctttatgcgtattatgcatatgtgtatgaaaagggatttttccccaccctacccccaccactaccaccaagaaccaattttcatctcttggggtcgatggcacccctattaagcatgcatgatctagagcaggggtgtccggtcttttggattccccgggccacattggaagaagaagaattgtcttgggcaacacatgaaatacactcacactgacgatagctgatgagacaaaaaaaaaattaaaatcatgaaaaaatctcataatgttttaagaaagtttataaatttttgttgggctgtattcaaagccattttgggtcgcatgtagcctgtgggctcagggttggacaagcttcgtctagagcaagcagtaacggccctgagcctcaggtccttatctgtaaaataaggatgagtgtgtggactaaatgaggcagttcttgtgggaaagcatccagtggtgctgagtgtggcaccaatgctaatattggagttgcattgctgtttccaacacattcccttccacactgagtgccaggagtcaggtccccctcctcacctgcagccagttgccaggaagacgtgctctctgcccatgacttccctcctgctccaggggacttcccaaagccctcacagggtaaccaggggctctgtccttcagcctggccacaactcagcccagggcagcagggccttgtggaccaccttcttcaatgccttctctctcttagtggacacctaattaatgctgaaggtccagaggccacccttgagggtagcccaggtcccctgacacccaaaccaagcctctcttccctcccctgagtgcccattggcagatgggtggtgcccaggcttgttatctgtgcagagacacatgctccattttccaactcctcccagacccctgccccagtctaccccagacttgggaggttgctaactgtgtgctaagtggttttctccctcagcttctgagagattctggcacttgcttcgcttcccatctcgtggcttcccactggccagtagggtccatttctgcacctgtggctcccaagaagctctaccttgtcattgaccactctgccctctctgtccagttcttcttctgtcccgttcttcttctgtcccatctgagtgagacatgcccctacaagcaatgccaggggccatcaaggaatcatctggaacactttggagacaaggaactcagtccctcttactcacctgtgattctgccagtgggcagtgctgtaagaacatgagcactggagtcatagaagactgccttttctctctgcccctcttgtgattctagtggctacacggcacatgtgaggaagctgattgcgaaggctataaacttggtgtcctaagctggggattgcagagtaaaacccacgaagtgagcagcctgattgcccagccttctgcagtcacgcctcattaggcacccattggagggaaaagtcaaactaaaaaccagaaaagaaagtggctttgagacgttgcctttttttcccttaaaatgtacttcttggattgtgtttctttatagatgtaatccttctcccgcattttatttgggaaggggttcataataggaaggagttgttttgaattatatcagtaaatattcatggagaataaaaggaaatactttgggattataaaagacagtgtgaacctgattaacaatgtgaacttgatcttgggtgtgctgggctggttttaggctgtgatgcttagcacctgggtgaccttcaataatattcgattccatcatcaagaagaaaggtttttcatgaagttgaaatgtgtccatgtgtataagagagcttgaaaattcctagcacttgggagactgtcgagtaggtcagtcagacctgaatctacaacatcagagagggtgtttgatggtatttttggggaaaccacagactcattcatgtggagtcaataactatctcttgggcagtatcagtagctgttattttaggcacctgagatatgcccaggaacaaaccagtgaagacactgccttcctagagtttaccttctagttactaggaaggtgagaggaggggagaaaaatataatgaatgtaataaatatgccatttatttggtatgttagtagatgataagttctctagaaaacaaaagaaaaggaaggagacagcagagcagggtggggaggataggtgtgcatgagcaggtgatgcaggggtgagactgatcagcctcactgagaaagtgagatttcagcaaggacgtcatggaggtgagggaattagctaagtggatacccaagagaagagctttccaggagaggagagtgggagatggggtgaaaggggtgtgtgtgggtcacacagatctctgtgagtctttgaaagatttaggcatctagcctgggtggcatgggggctgctacaaattgtgagagccaggctgagacagacttcatggtgagaactggttgcaggactgaactcttcatcctgaaaggtaacagctccaactcagaccatagatgcaggatgcagggacccctgatctcctgaggctcttctacccaggctctgggtgctgcggacctgagaggacaagttggtgcaggagtcccacctccatgcttcctgggcccaggggatgctgcacagcccagtttctagacctttccttctggttcagctgcctgactcaacaacctcccaggaggcttccttcaggggctccttctgggtgagtgtggggaagaacaaggacatagattatgccctgggcaggaaaaatgaacacaaattcagggtattgaggaggcatctgagaagatgaccactgcgtacccagcatggccatcccaagctaaatctcaggagtgtggaccttgacttgaagacatcaaaggttattgtaagcagtgctctccgaaaatgggagttccctgagctttagcagatgtaccctccagctttagcatcccagggaccccgagatcttgaaacccattgcccttcaagtatggctgggagcgtagcaggctttcagagacaaggtaacccgctggggcaatatttaaagtcacacaaactctttacaaggtttacacctagaactctaggctcttattaagattcagagttcacaaatcccccaaatgtgaggaaagcaactcagagactctctccttggcatgttgaaggtgtgtaactaaaaggtgctgggtgtttcatgtaggaggtggaaagaatcattgcattgatttggatgaagcctccttcattgaaaaatatcaaaatttgcatgaaagacttttgctaaagtaatagcaattgaaatattctttgaagtgctctgaatataaatatagaaacgctcccatggagacctgctcatactggcttcttgccttatcgctgtctcactgggttcactgttagcctcagagggggttatacagtgtctcaaccatactgccttgggctgcctagcctgtgtgtgaggggtggaggagtcctgagtctggttcttttttttcttccctttcctttccttccttcctttcctttaccttttccccttccttcctcccttctttctccccttccctccttccttcctcccttctttctctccttccctccttccttccttccctccttccttccatccatccgtccgtccatcaatccatccatccatccatcctccctttctcactgtgttgcccagactggatctgaactcctgggctcaagcaatcctcccacctcagtctccagagtaattgggactacagtcatgtgtgccaccacgtctggcttggctctttcatttaatgacaaacattctaggggcccagattttgcctccaaagaataaataactcatgaaccgtgagagcactccaacaaatgagactgtaagagaaggaacgcactacctgtctccaaatctgggtgcatctggagaattttaataccctctctaccctgaacctatgcttcgcaggctacttctcccagctcctgaaccaccattgctgttatagagtcaatggtgctgtgggaacatattcaattgctaagagggctgaatatattaagccacaaaataaaaatgaaaggtgccagagctcaaaggcccagagatagtgggggccagagttagtcccattgcaggctgaagaacacatcctttgaagtgggtgacaggggagaaaatcaacacccaaacaaagagaaaagccagcgtgcagaaaggaggatggggcagacacacttaaggaagcaagaagcagagacaatggggaagagaaaaggaagagaagcctgggtatcgggtttccaattgtatgtccatgatgccaaatcatttttcatcccctgctcaagattttctgtaaggcaatttgagctattttgagggatgttgtgtttttagaaagtatatttccctgatgagaacatctcacctaagtgaacacctcatctggatcttcaatcttttccttgctctttcctcagcaaaatgccaagagatgctggctcccctagctcagtagctgccttcatgtcccctcctctctctgtgtccaggtccatgcttacccatcccaaatcctgtaacccgtgtgttatgagccatggattcatccaaagtgcagactccaaaccacactaactcatatgggtatctggtgctccccaaggcagcacagcttgtccaagaagtggaactgaatgtcaatgccttcatttcactgccatgtaactccctgggggaaacagcccaggaagcagctgtgtgggctgataagggcttctctgccttgtcggaatcctcaggcaccagctccagataacggccagcgacaggagtcagtacctgtgccaggtgtcaagccttccccttgagctacacaaactctcaggtataccatgctgccctgcctggacatgtccctggcagaggggtgggccttttcatcagaggacgggctacgtttttccttgctacactcaagaacggtaggagcccttactcacttcttgtcaaaagcaggaggcaactgtcttcagtgattaacaatgtaagccacttactagctttgagactttgggcaaggtgcttagcatcttggtaccctgattttctcttctgttaaatggagacaatgatgtccctttcttataggtcagaatggggaataactgagataatacttgtaaagcccctataacagtgcctggacataataagcactggataaacacaatctatccttactgttaagacattaaagttcttcaatagttttccattggtcttaggataaaagcaaccatctatactgtggcctgaagatcacacatggtcttgccctggttgctgttactcccacatcatctcactgattttgcactcaaaccacatttgcctcctccctaccccaggtactggccctacatctttcaccagaggttctggccatgctgttccctcactacagcatgattttccaccctctcttggtttggttaacacctcttccttcagttctgagctctattgttatttacttgggcaaaccttccctgctcaagtccaatgtgccacaatggcttttaaaggacaagaaccatgattttgcacaacttgcaggagcattgttcacactataacaatggggatggtgacctctggagtggtacagaacagcagccccatagggcagtggtttcagccagaggtaaaacctgaccatggggccaggatctgtaccactggtcggtgaaggaataaggacatccaaaaggcaccatcctgtgccaacattttctttgtgactcagagtcaaagcactgattatttggtcttatgtctcacattgcttcttctaccatcttcccactatcatcttaacatctgctgccaaagcaccacttacagagaacacactaagaaaaagcaactgacactctacttcaagccctctcctgcagctacttctgaagcaaatattactcatgcaatttcacatttatctgtttatctgattaatattttccactcagacaagactctaagcaacacacacaaaagggccatgttggctctggtgattgtagtatccttagcacctaaaacaaagagtagatcctcaatagatatttgttgcatgaataaataagctccagtttcagtgcccagggctgttctccagccccaaattgccaagcccagtgcctgaaattctaccactatatcatatatttgagcccagtccctggttcaagggaagaaatgttaagaacctcaactacactggctggtaatttcagaatcagtcctttcatcaagggggcattatcagttgtgtccaggtgagctgctaaattgtagtctttctacccctgtccagttgaactagggagtaagactggggtcaccttagagggatcatatggcaggtggttggggctgagtctccatgtaggttggtccagaatgtagtcaggacatcagcagttttagcaagacttctctactcctaggatgtttatgcagctagtcttcaggctattttgggtactggggggagagtggagtcaccctgtatcaagagactccaaacattccttacttccctaatatccaagatgtaataaaagcatgaagagtccaaccttcaaagatgagaagatccatcagcccttggctatgtttccaagtgaagggagacaattaaagacagaggagcaagacagttggtcagaaaataggggttctggactggagagtgactgttaaacagaagacagggttttcttaactcttttttttttttttttttttttgagatggagttttgctctgtcaccaaggctggagggcagtggcacaatcttggctcattgcaacctctgcctcctgggttcaagcgattctcctgtctcggcctcctaagtagctgggactataggcatgcaccaccatgcctagctaaatttgtatattttcagtagagatgcagtttcaccatgttggccaggctggtcttgaacttctggcctcaagtggtccacccacctcagcctcccaaagtgctgggattacaggcgtgagccactatgccaagccagggttttcccgattctgataaagggtttttaattcaatttagaggatatttgctaaagtttgaaagtccccccaaattcatacgttgaaacctaactctgaaaaagataatattaaaaggtgggacctttgggagggcagaactgtcaggaaaaggattagcgcccttataaaagagaccccagagagacacctttcctttttcaccatgtgaggatgcagcatgaagtttgccatctacgagaaagagaacccaccccagacacctaacttgctggcaatttaatcttggacctcccagcctccagaactgcaagaaaaaatttctgttctttataagttatcctgtgtgtggtattttgttacagccacctgaatggactaaaacaatgtctaactaaaatataacaaaacacagaggcttctgccacatcctaggcaggaagaaatgacagggatctcagtgaaatagggcctatggaggacacgcacattttgctgagtacctactgtgtgcctagcatttcactaggctctgcagtatacattgcgttatttactttgcagagtaacaccaggagtgaagtaccacccttccaactttactgctgaggagacaggctcagagagggtgagtgacttagtcaaggtcatggaactaatggtatgctgccaggctgggctctggcttctgttcaaagagtgacagccttgtaagtgtcaccaaaggaagcattttgaggacagagttgcagaactatcagttcataaatattcatttttaatccttattttcaggcagaagcttgtgctttctaaatatttagattttttatttgtaaactgacaggatcctatcattgacaagaactctcagagggaacagaatccactcctttttgattgtcacatccccaaatgacctgtctcccgcatggatgcatctaacagcctttgatgctagcagtggccagcagcagcaacctcagactataaatgaacctgttgataccaatatgaattcgcagttgtaataatagagattatggacatacatatagaggcgtctcattcgcaatgacttgaccctgaccacaattctgtgtagcatgcagaacggtgtgacaccatgtgcagggaggagaggaaagctgtggatataccaaaaccagagaatgaaaggtcagatttcacatgcacactgtttgagtccaagtccagctctccttgccctgtaccaccctacagttcatgaatcccagaatgggtcaccagtaagacctgcatcaggaaccacaggtcaaagatgccaatgaagcacctcacagcatgagtcatgcaggaaccaggcggagaacctgagctgaggccagagggtgctggggtggggtctgtcaccctgtttgggaactgggggctccagggaggtgggagcagagagggcaagtgacagtctaggaggcagaacaggtgcaagtcagcacctctaacccctaacatctaaataaaaaagcaatgacctcagtgtgtttcagcgtctgccagctgcagggaaatgtggcagtttccctgagcagagagcatcactgccatagcccatctgtctcactctcaacaccagctctttcttctcaagaacttttcagaggcagggtctgctgccctctgaggttcaaggaaaaggtcaggtgtggtctgtggacaaggggaaacctcattaaatcaagtgtcaaacgtaaaataaataaagccacacatttattagaagtaaatagctgtggctagttgtttgatctctggtctggactttttaaacacgcaagtaaatgaagaaaatgtaccttaataaacccagtgatagagtttaaaaatcatacggtaataatgttaaaacttacaatcaaataatattaaagggaaacaacaaaatgaaaaatacataaacatatatggcagagaacgtcaatattttcaaatatgaaaaagctcttacaaatcaataaaaaagaagaacatgcaaatagaaaaacaatgataaatgacatgaacaggaaattcaccaagatacatattaccaatggggggaaaagagattccacctcaccagaaatcaaatacttgcaagtttatattagatatctaggtttgcttttctaaacagtaaagataatttaaaatgataatacagagtgttgctggagtgagagtttcatgcattgctgatggggttttatatatcttttggggttaatctcatggctggaagcttcttacaagaagttagtaacaactagaatctgacacagagagcagaatcacagcaaaacaaaaccaataaccaaaaacaaaattatagaccagcatatcaactttaaaagaataatatactattacaaataagaatctattccagaaattccaccaggattattgtaattaacattcgaccaaagtaattacctttagccatagcttgaagttaatcccaaagactccaaaatgtatttgacaaaattcaatatcaatttctaaagaaaaagtaatgtatttgtaattggggtgtgtgtgtcggggggacagggaaagtctttcttaatggaaggggacagtcatgtctgtgttatatccaacaatcctttactgactgcccatcaggtggcaaggatacaaggaagagtgagacacagtctctgccctcagagaggttacattctactaggaaagacaaggggtgccacggtgtaaatttgaaccctactgaattcatgttcaaacttaattcccattgtggtggctctaggaggtgaggcctctggggaagtgattaaaccaggatggttttgccatcgtaaaaggctacagggaactagcttaggcccttttttgcccttcagccttctgccatatgaggacatggcattcaaagtgtcctcttggaagaagggactaggccctcaccagacaccaaacctgcccccctggatccgggcttcccagcctcctagaagtttgagaaatatatttctgttctttattaattacccagtccatggtattctgttataacagaacaaaggaactaagagaggtggtaaccaagtaaaccgataaataaatgagatatagatagatggatggatagataggcagattttctttatttaaacataaaaggaagtgaatgatagatgctatgaagaaaagcagggtgaaggcttatagaatgattgacagtcaatttcatttttagtagtgaaagtcaggacagtcccattaaagcaaaaaacaaagaagggggtgcctgctcagaacattagtgttcaacattgctatcagaatacaagcaatcagaattaaacaaacaaacaaccaccataaccaataaagcagcatgggaggatataaagatagcaaaattctttgggaaaaaaatgtggaagctctacaaattaaaatagttccagaatccaaaggctgaattttgccaacagcaaatgatcacagtggatggggaaaattgcatccccaattacgtgagaaaactgtgatgaacgggactaaaaagatacgagcttgccggatgaaagatggaaacgctccaccctgcaggggagaaatagcaatcctatgttcccacagcagaaaggagagacattctacagttgattcagtacaaaactgtctcagaaatgtcatcgggaaagaatcttctcacactggctgaccctcaccacactctcaagagtctcatattaaggaatactctccctgagagaacttctccaaagcatgttccctctccaggccacagctggttgcactctatgacagtgatcaatggctccattgcggagacatgtcttctgttccattcctgtgaccagacagtccagttgcctttctggaaaagaaatgccacagggctcctgaccacagcataacaggctctctggggagaagttcacagccagaccctaaccctcaccccaagaacctcaccctttccatggccccttctgaaagggaagattcaggaggtacaatggtgaaaagctcagacttgggtgttgggcggatatcagcagtgttcatgacatgaaatgggagtaagaagctcctaagcagattgaggcaaagaattccagacagaaggagcagctcaaggaaagatccccagccacaaaagcctggggagtacgaaaaaatggtgacaaattctgggtgatcgagtctatagtgggggagatgagcaagagtagtgaattggggtcagattgcaaagggtcttgaaaggcgcgataaggaagtcaagcttcacaaaactgtgggatgccagctgtggaattaaaccagagactgacgttatcatatttccccttttaaagaaagcacacacgggtgatagtttggatcgtgtaaagagaagctacatagaaagagagggagcaaggctgtcagatgcgtgtcttttggttcatattgcaattacctccgtcctttgataacttggataaatgccattttcaccactctgtttccttctcagcaaagcgatgcatttcacctgtgcttgaagaacctttgcagaaacattcaggggcaatagaagtcaggcactgggtggagttgcccacagaagagagaaaagcaagggagatctgcctgtgagcccaagtggacccctgagctcagggtacatgctaactccagaaatcctcaagtctaatgctcctccaacaagtggtttattcctagaaggtaaagatgcccaaaacgtggtggtccctctgggcaaacaccggtcattgcccctgattgcactcccccaacacaaatgtatgcatgcataaaccagtgttttgcaagctttaacttacgaccaaactgaactctgattcagtagattgggctggggcctgagattctgcatttcaaacacattcccaggagattctgatgctgttgttaattggtggatcctacatggtgtaacgaggttctaaacaccaatagactttcagctgcaagctctttgtctcaatttcaaagtaccactgacctcaacctaaaacctcaacctaacaaacgacctcaacctaaaatcctgtgcttccggttgtgagccttgtgactgtggaggagacatttcctagcgctgagcctcagttcgccacctctgtaaattgcctgtggaagacatggctttggaggacagaaaagaaaagtgaaggaagagaaagatgaagccagagtgaagtggtagcattagtgctgtgattcacaaaaataacactataggaagaacctggatgatagtattctgaatacagcaggagcaccaatagagtagcagtagtaaaaatagcatcattataactaatagtgcagaaatagtactaggggtcctacccagaggaggactgattatttcagaggcagaggttggggcagaatagaaggcttaacagatgtggtacatctcactggttgagaattcagattctggagccaaaccgacatttgatgaaatgaagtgtgtattgaaaacagcacagcaacccccacagagtaggggaaagaatgtaagatccccaaggagagggaccgtgatggtcttgctcagcattgcattcctggtgcctaggacagcgggaggcaccagataaacatctcttaaatatattaggagtctttgattctttttctgttctcagatacctactgactgtatgattctgagatcacacctctcttcttggcttcaattctttcatctcgaaaagtcaggatttgggctgtgtggcaccaaagatgctttccagttcctgtgttttctctcctgatgccctattttactcttcctttgcaacctgatagtatcttttttggttaattgttcactcattttctgtctccccactagaccgagttctccaatgtgggaatctaagttgccatcttgcacaaccctgtaatcccaaaacttggcacaaaacctgaggcatatctcagtgagtatctgtcgaatgaacaaaggaatgaacaagctctattttcttaagatcactggaggcagcattgtgccacggttaagatacgggctctaggttcagactgcctatatttgaatattgattcctccagttaccagttttatgacctgcaaattatttaacttcctgaggctcagtttcctcatctgtagagcgcagatactaatggtatccccttcacaggattttgaaatgattaaataattcatgcaaagctgttaaaatagttctgacatgtagtaagcattcaatacttatcagcctcatttagagaaaaaagaaattccttgtgaattccatgtgtaatttgacaggtgtgacactgactcaacttgctccagcaagtctccaaggcaaccattccccacttggtgcttctaccgtgcccccacagctccatttttgcacttggaatgctgcatttcgttttgaacatgtaagcctttgcttctgccttcaggtgctcaactctggcgtgcccagcctccccagtcttatgcctaccactccctccctcagtcttgctccacaaagtgcctctgtgccttggcatatgctgtcacctctgtctgtgatgaacttccaattttctacaactggccaacacctggtcattactcaagtcccgggtcaagcccctttattgcaggaagatttccctgaatctctaggctggtgaaatgcatgacaaagttctattcatttccctgcagcaatagagaaatcccaactgtttaatcataacagaagaggaaaacaaagaaaaatgagtgggagtgccttggtataactatgacaccctaatcatcatctcatggggagaccctagaacaaccagactcaaatttgaggcatccagtgcatgcttcccagagcctctcactcttacttttcctagaggcacctgagcctgtggagggcagcaggagctcggtctccagctccaccccttctccacattcctacaaaggagttatatgccaggtacctcctttctcggccttggccctggccgggtgattgggaaaatgaaacagactggccgaggcttgatgcccctaaattgtaatttcaaggtaatttgaacttccttcttcttgggcatgaatggaaaagctaaagtctccttgaatcagtgtgcagaactcaacaaagaattaaagtgcccccatgctttcctccaaagcttgtgtgagatcagcaggataatcaattttacaattctgtgaagctgattggaaagtgattacaaaggcagtcagagcattttctcatgggctttcaaaaggcctgttgcagagggacgtgaaggatatgaagtctggccatccatagcaagcccacaaaaatcaaggactccttcactcccaaagctttaatctctggctcccatgagttcgatagtcaatcctgcccaaggcctatagagtaaacgtgtgaggctggtagtccactaagaacctaagccctatttcagtagatagctttggggtcagaatgctactgcaggctgatttttaaaaaccttgaacttcagtgttgccctctgctgcatcctgcctcagtttccttatcccactctctctagctccctgtggagactggatccctgatctaaatcacgctgccaccttctccatgtgctggagcactgtctcctaaaatggccagctttctggcaccgagatgcattaggcactgactggtaggctatgcagagatcaggtttagcccacactcactgtcctgcctcagatgtggaacaacctgggccttccctccatgcactcctcacttcccttagccccaggcctgcctggcctggttggtttcagatagttccccttctcataagcctttgggtctgagaactggaacagagaatgtgtctccctcccagacattgggccccaatcggaatggggaagatggtcacacagcaagaaacagagaagccccaggaaagggctgccaaaggggaaagaaaatgagcctgcttggtcctacggctcttagcgtagctttgcattgcacttatcatgctgtcttgagcgtgtttttgttctcccattggactctgagctccccgacagtagggtgtgtttctaattcattttgatatcatagattattaccttaattggctcatggaggtatgttagtgtgttagtccgtttttgcattgctataaagaaatacctaaaactgggtaattgataaagaaagaggtttacttgttcacagttctgcaggctgtacaggaagcatgatgttgccatctgctcggcttctggggaggcctcaggaaacttacaatcatggtggatggcaaaggaggagcaggcacatttcacatggtgggagtgggagtaagggagggaggtgctacacacttttaaacaaccagatctcacgagaactcactatcgggacaacagcaccaaggggatgtggtgttaaacgatgagaaactgcccccatgatccaatcaccttccaccaggccctacctccctacctccagcattggggattacatttcaacaggagatttgggtggggacacagattcaaaccttattgggggccttttagattcattgtagggtgatacttttgagccctttgaagttaggtatggccagatgacttgtattggacaacaaaacgtgagcagaagtgacctgtttttatccaggtaagtgctttaagagccaaagcccaatttgccgctttctattttccctctgacatgatgactagcaacgttcagcttggtggcagctccgtcagcccgggtccctgtgtgactgctccctgttgacccatgatggacgtgtcatacaggtgagaagtaaacatttgatgttttaacatatagtgtgggtgaaagataagcttttgatgtttgatgtttaacttttgagatttgggaatttgttattgaggtgtaatctagcctaacctgacagatacagtgctcaatatatgttttagggtgagtgaaaggaagggaaggaggagtggaagaaaaggagggagggaaaatgggggaagaagggaagggagaagaaaagagaaggagggagaaatatgtaaatgacccgattagtcttcacctctctttgggtctgtttccaacttagacatctgggaaataatgttcatctttactgtgttcccttctaccttcaacacagaaaacctgatacgattcagacacaaactccatgcctttttttgtataaaagaaaattctattttctcaaatctaatgtgtaacatagcgatatttatagagaaaggtggcagagaaatgaggcaggaaacaaagcaattgtgacttttttgggtaatatatccaagccataaagatttcattagattccataatacattgctaatgaaaaataagaccctttcctattttacctactttctgaacattagaatcaacttggctttccaagctttgcaccccatttacattaattagaaagttccatattaaggaaagcttttaatgggctgttattgcaaatgattttactggtgagctgcattgttctgtttaatagcacatacaatggcatctatagaggagactttgataaaattgaagttttgatggactctgggcctgagctagcctttgctgagaggatggagttcggggatattttcctactgagggaaatggctcttctctttccctggactagagccagttctaaagcatccacatgtttctgatcccaggagaaatccacactgccttctgcctgggtacaccattggcagactgcttccagatccctgtacatcacttggcaatatctctcataggtgttcatggacaagacagagccgtcctggaactgagacataagggatgaatttcataaacacagactgcctgggccaggtggagagtgtcatggagatgggtgctaggtccgtgcaggaaaacagggggagaagggggacaaagcagaataaataatggctgcacataatagcaattgacacagagagtaaggtggggaacagggagaatcggggtatggtggggggtgtaagaggaaccagagcatgctgtcatggcatggagaaccctataggacggtaaccacttttccatttgtctttgtccctatccatgccctgcataaatggtgccacccataggtggtcactattgctcctgaaggttttccttggtcttggcttccagctgcctactactgataggatctccaactatcactatagcatgagaataaagtattcagaaggcagtgcagtatggaatttaggtgtctgagctctgcaattacatctgggtttacatcctacctctcctgctaaataataagtgtaatattctgggccaagttagttaatctctctaaacctcagtttcctcaatttaaaaatgaatctgcctgaagacttcctggtatctaaagtgcactcaatacatgtgagcaattataagtttcattaaataaatttgagtggtttaaaacactgagacttcgggcagagcacaggacttctgaaattatagttacactggtggagttatggaatacaggtcctcagatctcagtgacccgtgaatggtgaattcagcagacatttttgagggtagacattctggcttccctggtgcctggactggatgctgtgatccatggcttatgtgactgtgagtaccatgggctcatgggtttttattcttgccatgctggcagaaggacactgctaagcagggatagacaaaaaaaaaaaacaactatttgaatggaccaacctggctgataaccttgaagcagtctcaccaagagggcttctagtataaatgggaggacaggagaatggccaactagttgaattcagagagtagagagagaagactagtctcaggccactgattctgcagtgtttgataagtggtaagaacccattagagttggttaccattacagctataataggaaaatacaggaataatgcaagcatattatattttgtcccctaagaatgggggaaaataccactatatcatgtgtagggccaaggcttaccctgctgtcagagcccatttagcatcttgaatttagttctagatgtgacatcttgagtttagctacagacccacacctcatctccatcagggagataaagtggtgagtgacgcagactttatgccccacaaagaataattgaaaggattctccagaagagaaaaagttattgctaggtgatgttggttgcattctagtaatcaaacagcagctgattttacgacggattatatgtattctttctaagtaggatatgtgggtagatggggtagggacgtagagacgacaatatggatggaagatttatcaatataagtttgacacagggcacatggtccaaatcaggtgaataccttgcaatgttgtgagttcctgtcactgtggggcttcacgttaaatgtggactcatccatcaaatgcatatggaccatgcactagtacagggtcagtgatactagctgggaacacaaagattaatacaatgtggctcttgctttatagtaattcactcttctgtgaagaacacagacccattaacaaattcttaaataaccactgtgtcacacataccagtgtagaaatgtgtacaaggttgtgtcaaagcaaagaagtgacggcagtggggaaggaggcaaatgtgaggtcagaaggtggctgatccttgaggatgaatcggtaggattctgatgggtggacaagggtgcgagggtgtttccatctaaggaaacaacatccaaaatggcttgaagaatagaccccattttctttatcgattcattcaccagtgggcatttaggtggcttcgatgtcttggctattgtaaatcatgttgcaatgaatatgggaatgcagatatctctttgagattctaacttcaattcttttgggtatatatccagaagtgagattgctgggtcacatggtaattctatttttaatcttttgagagaactccatactattttttcatagctccattttacatctccaccaacagtgtgcaagttttccacatccttaccaacacttatctttttgtttttaaaataatagctatcctagccagtgtgtgatatctcactgtggttttgatttgcacttccatgatgattagtgatgtttagaatcttttcatgtacttgttgtccatttgaatgtctttggagaaatgttgattcaagttctttgccccctttccaatcaggttatttgttttcttggtattgacttatatgagttccttatataatttggatgttacatttatcaggtatatggtatgcaaatattttcttccattctgtaggctgtctcttcattatgctgcttgttgcctttgctgtgcaaaaccttgtagtttgatgtgattccaatggcctatttttacttttgttgtttatgcttttaatgttatatccaaaaatcatcgcccagaccaatgtcatggagctttccccctatttcttctaggtgtcttacagcagtagatgtgagagatatttaattaatattagtacattaaatctttaatccatattactcagcctcaaaataaaaaaggaagtcttgccgtatgtgacaacatagatgaacctggagggcattatgctaagtgaaataagcaagtcatagaaggacaaatactgcatgattccacttatatgaagtatctaaactagccaaatcataggcacagggatagaatggtggttgctaggtgctgggtagagggaggacatgatttgctgttcaacagctataaagtttcagttatatgaggtaaatacattctggagatctgatatacaaggctgtacttacatttcatagtactgtgtttcacagtgtattagtctgttctcatgctaataaagacatacctgagacttggttatttataaagaaaaagaggtttaatggactcacagttccacatggctgaggaggcctcacaatcatggtggaaggcaaggaggagcaaagtcaagtcttacatggcagcaggcaagagagcttgtgcagggggaactcccatttataaaaccatcagctctactaattcactaccatgagaacagtatgggagaaaccacccccacgattcaattatccccacctgcccccctccatggacatgtggggattattacaattcaaggtgagatttagatgggacatagcaagaccatatcagaaggttaaaagtttgctaagagtagagatctcatgctaagttttcttatcacaatataaataaaataaatagatacctttgtcctaaaataaacaaactaaaacatgtgactctatgccatgcatacacatatataaagctttgaataaacaaaaacactgttattttactcacacacacgatgttgaaaaggcatgattatatgaaaagcatgcaggacatcatcagaagtttggcactgtgagagcacaggatgtaaaaggtaaggtctaagagaaatggggctggagaggtgagccaaaatcccattttagagcctgaattttagaaacccgtgggactaataaaaggtattatacagagagtgacagggttagattttgtctttggctttagtggtataattgaaaaactgtcccaggagtttaaaaaagaaaatacggggacctaactaaaaatggaggtaaaactgagagaatttgaagatcctctggaggtacaggatgagggatggtcttaggacaggctggctctcaaatttttaggggaacagccactggggatacctgagaggagtggaactggacaaaccaaagggaagagggacctttcatttttggacatctatggtatgcttgacattgcttctatctttcataccttcataacgatcctgcaaagtaagaattattatcttcttgggaggctgaggcaggtggatcacgaggtcgtgagttcaagaccagcctggccaagatggtgaaaccctgtctctactaaaaatacaaaaattatctgggcgtggtggtggacgcctgtaatcccagctatttgggaggctgaggcaaagaattgcttgaacccaggaggcggaagttgcagtgagccgagattgtgccactgcattccagcctgggcgacagagtgagactccgtctcaaacaaacaaacaaaaaaaaagaattattatcttcattacatatgagaaaattgaagctgttttatgtgtccaagatcacaagatcatatagctgagaccaaatgtgacccataattgtctgcattctgaaacctatgattttcccactagatcctctaagttcctttttttgctccagatttcaggattctaagcacacaaattaatttttatctgttcgaaattgaaataaggcaagtcttagtggaaatgatctgactttataccaagcctggttatatactctcttcatattaaacatattcatacagaggataagcggtacctataaatatcattccaataaaaatgaggccatgtattcctgagtggtaatacgctgcttgggtcagtgatataaaccaggaggctgaaggccaaacaactttaaccagcccagagattcaataagttaaaatatgttttggaagacagctttaggccagacctgctttttttcttgacaattatatgaagacaccttattcagcacaagcaggctggctacagggtgtgaatttttgtttaaaggggcagcaacaagtcatacaggcaacagtgatttgaattttaacttcagaagtagaggtgggtaaccatggtctttttgttgttgttgtcgtcgtcatttgttttgtgttattatttgaaaatccgtatccacaaaaatctcactaacagattgtttccttctcctgaaatgctctcccgactccaacactttttaatctggaaacttcctatagggcaaattttagcttcttaattgggggagattttgccttccaaggaacacttatttgaatatacctacagacaattttggttgtcacaacttgtgtatgtgtgggtaaaggacctctaaaagttagagttcagggatgctaatattctttttttttttttttttgagatgaagtctcgccctgtcgcccagactgcagtgcaatggcgcaatcttggctcactgaaacccctacctcctgggttcaaattattctcctgcctcagcctcctgagtggctgggattgcaggcgcccaccactaagtccagctattttttgtatttttagcagagacagggtttcaccatgttggccaggctcgtctcgaactcctgacctcgtgatcccccaccttggcctcccaaagtgctgggattacaggcgtgagtcaccacgcctggcccagggatgctaacattcttcagtgcataggacagtccccaaaataaagacttacccagtccaaaacattaatagtgctaaggttaagaaacgtgatatagcaataccattcaggacataggcatgggcaaggacttcatgtctgaaacaccaaaagcaatgacaacaaaaaccaaaattgacaaatgggatctaattaaactaaagagcttctgcacagcaaaagaaactatcatcagagtgaacaggcaacctacagaatgggagaaaatttttgcaacctactcatctgacaaagcgctaatatccagaatctacaaagcacttaaacaaatttacaagaaaaaaacaaacaaccccatcaaaaagtgagcaagggatatgaacagacacttctcaaaagaagacatttatgcagccaacaggcacatgaaaaaatgctcatcatcactggccatcagagaaatgcaaatcaaaaccacaatgagataccatctcacaccagttagaatggcgattattaaaaagtcaggcaacaacaggtgctggagaggatgtggagaaataggaacacttttacacgttggtgggactgtaaactagttcaaccattgtggaagacagtgtggcgactcctcaaggatctagaactagaaataccatttgacccagccatcccattactgggtatatacccaaaggattataaatcatgctgctataaagacgcatgcacacatatgtttactgcagcactattcactatggcaaagacttggaaccaacccaaatgtccatcaatgatagactggattaagaaaatgtggcacataatacaccgtggaatactatgcagccataagaaatgatgagttcatgtcctttgtagagacatggatgaagctggaaaccatcattctcagcaaactatcgcaaggacaaaaaaccaaacactgcatgttctcactcataggtgggaattgaacaatgagaacactcggacacaggaaggggaacatcacacactggggcctgtcgtggggtgaggggaggggggagggatagcattaggagatatatctaatgtaaatgacgagttaatgggtgcagcacaccaacatggcacgtgtatacatatgtaactaacctgcacgttgtgcacatgtatcctagaacttaaagtataaaaaaaaaaagaaacgtgatatagggtcttatctgattctcaaggtaaattaggtcctccacgatttatgttttcacagcaaactaaattcttctttcacagcacacatcacatgttgagagacatgttatttgtatgattactgctatggtttgaatgtgttcccccaaaaccatatattggaaacttattacccttgcagcagtgttgggaggtggggcctaatgggaggtgtttaggtcatgaggtgtctatccttttgaatggattaatgttgattataaaagcacttgaggcaaggcatggtgtctcaggcctctaatcccagaactttgggaggacaaggcgagagacttcttgcttgagtctaggagtttgagaccagcctgggcaacacaatgagaccctgtcaccacaaaaaaattaagaaatacagctgggcatggtggtacatgcttgtagtcccagctactccagaggttaaggcaggaggattgcttgagcccaggatgctgaggctgaagtgagccatgattacaccactgcattccagcctgggaaacagagcaaaaccctgtcaaaaaaaaaaaaaaaaagaaagaaagccttgaggctgccagtttaactcttctctctgtctctctctctcttcctttgcccttctaccataagatgacacagcaagaaggcgctaaactgtgacctaataaatttctcttcattataaattagtcagtctgtggtattcggttatatcagcacagtatggacttatacagccatctaatagctttcttccctatgcaacggactctaggagggtgaggaacagcattcaattttctcccaattgtatcctcagcagctagtataatacttggcacatattaggtgaaaccctgtcactacaaaaaattaaaaagttctgggcatgtaatcagtaaagacttgtgaatgaatcaacacgtagtaaaagagagaatgcaatcagtcaatacattatgcttatgaaattacatctctacttcagttgaaaaaattgatgaaaaatataaattgattgattaattgattaaggaaagtataaaccaggaatcatttgtcaccatggtgctgcagacccacacagtactaacattaaccaaagtaaatgccagcttccattaaccaacgtaaatgtcagtggtagtcagctcccaagatggtccccaaccatccctacctcctgttattcacatccagatgtagtactctgctacttccaaggctagttcatgaaatgtattataatttctttcccttttctcttggctcacttactctagtgaaagccatgtgccatgtcataacatactgaggcctctgacaatagctgtgtgagtacaccatattggaagtggatcccccagtcccagtccaaccttcagatgactgtagccccagctgacatctcaactgcaactttaagagagaccctgggccagaaccataagctaagtcactctaagattcctgactctcacaaactgtttaagataataaatatctgttaagtggtaggaaatttaaatttaaccaaagaacaggaactttcttgagtaccgaccgagaggctggcaggtaggactaagaaattaggttatggagtcagaattgagtttgcaaccttattttatttaggtttactccgatgttataactgaccctgaccaagttacttaggtcttttcattgcttttaaaatcagaataatatctacttttaagggccacaattaaacacaaattgagtaatatgtagtggggtgagttattaatgaattaagaggtatttgagaattttttagaggaaagagggaggagcgtggctaggaactctttaaaatgagaattaaaaagcaaatgtccttttcattgtgagttctgggcttgcttgtccaggtaggaattaagagttcacttttcagatccctcgactacacctcacaggaaaggaggaggagacttttgtgcttcagcagcaagagaagaggggcatggcttgattctgaacacaagtgtagaagtctgaaaagctggaggaggattacctgagttgcaagaacccagacatggtcccctgatgtcacaatctgaacacataacatggcagcctcaggaactggagccatagccaatgtcctggcggccaaacttagtgtgtggggcacggacactaccagcaaaggttccagggcacctcaggcctggacgactcccatcacagaggcaacctggagggaccaaagaccagcgattcttcttggacttcctgtagtgatagggtacgccacagttttttgtttgttcgtttgtttttaaagcctaaagagcgggaggaagggaatgcaacaatgatagagcttggatgagccactagccacaatggtgaaagacaagatgttttattaaattcatcaaaatagaagaaacctgattatgtcttgcccctggtgtcatccagcaagtcctacatactgaaaacagatgtaaatgctctgtcctataactaaatgctattggatttccttttctttcagatgccgagcataagcaagttaatcattgatgatactgtctaggttctccccaacagaagagcttctaatgtcggatgccctacaggagtcaacaacattgccacgggctctattttcctccctgccatgatgggcaatggccagagaggggtgcactgtccttgccaccacactgtactgctgcacccacctgccccaagccctcccttgttctatcccactgttatacctgatgccaactccctacctcacagttaatttgtctcctacaagcctgtgttttccctcatgtcttgcttctatttcagctaattccaggaaaaaatgttacttaaactcactcagttctaacacatatgaacatttcctgccctaccttttctcagaccttgcatgaaatgtctttgtttcctccctctattctgtaagtcaactaagaacctgaaaggtaagagggctattagcatacatcaggaaaaatgggaaaaaagtaaaataataggttttgataagaaaatagaggctgacattttcctctactgaagggcgtttgctttactaatctttcttttggtatttctcaaaaaaaaaaatccatttcatttttcttaccttaacccacatatttatctttctttttaaaaaaataactgccattttgcaatgacctacagttcacttggcttggcataggaagaagtgaggagctacagagtcaggcagaactagctttggttcctagaaaagattgcaacataatcacagctgcttagttctacccctatcttcagagatttatggcttcacagtataaggattggaaaagcctgcccgggccctgaaaactcagagggagtatcatccatatgcaagaaactttgaacagctttcagaaggtggaattcacatggaaaaggacagaaaagggcatgggtggtgcagggaagaaaagatttctttcctcatcggttgctaggttcatggctgaggcacctaaaacaaaagacagattaacaagagaaaagcatacgcatctatttaatacatgttttacacaacaaggaagtcttcagaaaagaaggcccaaagaaagaggaaaatctgattttttttaatgcttacatttgatgaagagtggacagttgtgccaaaatataattggaaaaagtggggattgtctaatggtgataaactgaagggaatttagcaagatctattttgtaacgattcttctccatccccctgtgtcttcagagataaggacgttcctctcctctgggaataggaagggcacctctggaataagggtcttaggactttcttcaggggagaaggctgggggaaggtgagatatcctcctacttctgctgtctacccaaatgccaaggtgccatatttgggggtagcatgttctgaaccccatcgattgtgaagtcagtaaatccatcttcattgtaaccctttttaaaatatgcatgtatattagggaataatttgaacataacacaaatgtttgattatgcctcatttcacaggagagaaaagcaggtgactggagaaaactgcactcagatgaaccaaccacgaaggaatacacaaaatgtatgcactcatacacctcaaacatctgcttccccactcagattacagtgtgtgtcagccacatctggggttccaactttccctcccatttcagacgatcttccatacaccatttctcaataacacacaagttggaatctgatgcccacttacacacagactgcatctctttcaaagtaaagtaccatatttattgtagtatttatgtattccttagctatttaacatgtctaaaactgagctaagatttttcctaggttcctattgtttgggtcactgataaagtttttaaatattgtatcctaacttcattcttcctataagccctgtaatttttagtgtgcaattttacatatcgtggcgatatttaggaatgtataggtcacatgacatcagaactgactgtattcgcaagcgttgggtgagtaaagagggtagatatcaacagaattgcatggaagagtcagggaagactacggcttcctatattcccgaatacaacctgcaagatgcccagtaaggcaggattgtccaaaacaaataaggaggaaggtaaaaatgcacaaagtctatgaagatgtgacaggtcttttttttttttttttaattttactacttgatggatatgccttcaaaaatggtgaaaatgtgtatcttccttagcagaagacacacttgtctatgtaatatccatctctctccccggccctcttcttcacttctggcaaacactgatttgcgtggtatttactctttaatgtggctatgcattcatcaaaggagatccccctttatcccatctcaaggtttattccacctcgagaataaatattgaagaatctcagtcaatcatgataactattttcttcaccagtgatcggttaacctatgggcatgggacctcattcttgccaatgaaacgtgagcagaaatttacattgtgcatctgggaatatttgcttaagagattcttaggaagggatgtccccaggtccacaggaaatgtctgagggcatggcagctatcttctgaccaagaggacggccagcctaaagacaaagcccacacactggggttgacagagcagaaaaacctgagtcaatcatgatgtttttaaaataatgaattaagcaattccgcagcttaggatatgattggataccttgttatatgatgtgacacattttccatatggtataagtcattttgagttggctttgttacttagagctgattattttactatttgtttagcaatactactttcagaagaatcaaaactatgagcaaagagtgacataaaggggaattcattgaatcattatttgttcagtgcaataatgaacaactagaaaaaactaaatacccaagatgagggagctggctaaatagattgagcccattttacagaatcctctgaaaccattaaaatgaaggtgatataaatgtaatatacattgatattgagaaatgttcaaaatgttcttgcccctcttgctcatttaagtcatttgtcacagtattaactctgctgaagcccatattttctgcctactccgagtctgctggacaagtgtgaggaaagcagtgacccatgctaactggtctcgttgtaactcctgtctgctaacctcaagtgctcccttggtatttcctggtgatcctttacatttccccatttcagtctcattttcagactcccacactgtttcctactttatggagtctcttcaaacctccaacacctccacgctctcctcactcttagctgataaccctgcttcctgtttcatagagaaaatggaagttccatggtgagaacacggcacatgtcagcttaactgacccatccccatacattctgtcttccctcctttttctacagcagaaggacctatgccgcatctaagaccaactcttctatgtgtgagtgagaccccctgtgctctcatttaccaaacgtcatcccaagagcagtgtccatcctctttggggctttttccctttccattggatcatttccctttagttctaatatttctcaaattttataaaataccaacaactccccaccttttgatcagagaacatcttcaggtactgtctcctgtctctgccttctttgtatctttctatacaattcctctcctgctgctctcccttgggcctgtgtaatcagatttcagtacccacaattctttataaattgctaatgttaactcaccaatgacctctctgttgctgcatctaatggtcaattctcagtccttattttacctgaactaccaacagcatttgacacagtggatcaccttctccttttgttctttttttattacttggcttcctggaccctgccctcatttttcttcttacttcattggctgatacttctgtctcatttgatgattctgcctcaaattttccaccttaaaaatccaagggtcccaaagcttagcactagaatctccctattctacctacactgagaccctttcacctcctccagctttacgtctgcaaagctcgtgcataggctgactcccctgctaacatctccgtcctctacttctcccctgaactccagactggcatatctgtctacttgatatctcacccaaaatatccaacaggaatccatctgaaacttaacagatgccaaacctaaatcccaatctttctctgaaacctgctcattccagtgtctttcctatctcagttaatagcaactccatccttccatttgctcagtctaaaatacctggggtcatttttgattcctctctttctttcacatcccaaacctactttgctaccaaattccattggctttatcttaaaactacatctagaattctactacttctcatcactccctcctactttggtctgagcctccaccatctctcacctgcattattaaaatgcctgctcagcagcctctctacttctatccttgccttcctttagcttgttgtcagcagagcagacaacatgatccatttaaacaaaaagccaaattagtttcttccactctttcccttactcactctattccaaccacactggcttggaacacgctaaccagtctctcccgtgaggccctttgcactttcttttttgtttgagacgcagtcttgctctgttgcttaggctatagtgcagtggtgtgatcccagctcactgcaacctctgcctcccgggttcaagtgattctcctgcctcagcctcctgagtagctgggattacaggcacccaacaccatgctcagctaatttttgcatttttagtagagacggggtttcaccatgttggccaggctggaactcctgacctcatggttatctgcccaccttggccccccaaagtgctgggactataggcgtgagccactgagcccggtcactttgcactttctgttctcactgcctggaacagccttcctccagacagaaatttgccttccctcaggtctctgttcaaatgccacctttaaagccaggtctttcattgaaaataaaatgtccctcccacacaggtggccagtacaccctgtccccattatcctgcttttttttacctgacagcattattgccgtctgatttactatatattcatttactatctgtcgcactcaactagaacataagctccagtgagatggtgtcagttttcccactgtcatttcagtgcctggaaaaatgctagacctacgatgcgtattcatgtgtttggtgaataaatgaaaatattgcgttaattaaaatgcacacaggttataaacaattttttgtttttgtgaaacaaatctctaggaaagccaatagttactggatatgtaatttttttgtcaacttttattttggaatcaggggtacatgtgccagtttgttacaaaggtatactgcgtgatgctgagggttggataccaatgaatctgtcacccaggtagtgagtgtagtacccaataggtagtttttcagcccttgctaccaccctccattctcccttcccctctagaaattcccagtgtctttgttcccatctttatgtccatgtgtactcaatgtttagctcccatttataagtgagaacattttctgtttctgtgttagtttaagttaacggctttcagttgcatccatgttgtgacaaagcacatgatttcatttctttttcgggtctgcataatattccagggtgtatatgtaacacattgctttatttgatcctccattaatgagcacctgggttgattccaggtctttgctattgtgactagtgctgtgatgaacatacatcacaggtgtctttttggcagaatgatttattttcctttgagtatatacccagtagtgggattgctgggtcaaatggtagttcaactcttggttcgttgagaaatctccaaactgctctccacagtggctggactaattttaatttccactaacagtagacacttactttgtaccagtcattttcttgggcaatttcttatgtcatcaaaatcataactattcaaagaaataggcacctagtatctccactgtaaatttgaggaaactgaggcttgaaaaatgtagttaacatactttgtattaaataactagaaagtagcagaggtagtatctggtttgatgatctattgtctgtggtatactacctcaaggtatgtgtgtctgttccacaaaaaaaattgtaaaaaaaaatacatacatgagaggatcattccttaataaaacaatagattaaaaggaataaccaatagatgtgtacaaatctgattaaactaatggttaataaaatgaaataaattaaaatggtatgggtttttttctattctattggcaaaaatatcaagcagcagtagccataatgtattaacaaaataatcatttacatgtgggaagatttatgtgcaaggattttcattacagcattgagcataacagccaaaaattatctaaaaacaggagcaggttaaataaagtatgtacatctcaaagatggagtactatatcgtcattaaatgatgcaaaatattatttgagatgtgaaaatgatgagtgtattatttcatgaaatatgcaggctacaaaatagcatgtatatcagaattcaaatggcgcatcgacaagaacaaaatctctttgtatatgtcttgatctgaatattaaaattctggaaggaagtcatctttaataacaataattacctcctcacagagactctatgtgtaataattttccattttaaatttatgtattttttaatttaaaaaaacatagggctgaatcaggtatctattggtactccaacatttagtggcttaaaacaacaataattgattatttcttatagttttctgagttagcaacctgagctgttctgctagaactgctcgatgtcattcaagtagccatagtcatctaagctcagctgaggctgcatgttccaagatggcctcactcatacaactggcagttggtcctgactgttggttaggacactgattctcttcatttaatttctcattttccaggagaccagactgagtttcttcacagaaaggtggccccagacactgggagggcaagagcaaacattcctagtcagtcaaggcgtttgaaaacctcatttctagacttgcacatcatcacttctaccactttctattagtcaaaaagattcacagtcagtgtggatttaaggggctggagacttaggctccgcctcttgctgagaagagtggcaatgtcacattgcaaaggggcatgggcatgggcatagggatgtatgattcactgagaaccattactataacactttatgcattgtaacagattatctatcacaaaggtcatccttcggcggtaggaactatggcaccctcagagtttatcacctatgtaaccatagctttaagcttgggcagcaatatgagaagccacccttagtgccaaggcaggggaggagaaaatggcagtgcaaaccaagaagtctaaataacagttcagaaatagcaccagaatcacctgggatggggagctttaaaaatacacttactcctagagcccacagaggattctgatttcaatgggataggcctggggttggactaataactcttttggtaaatccctcccaggtaatccagatgcttaacctggttttgaaatctttgcactaaacacaggatatcctgagggctcagactcattttgaggaatactggagagaggctccttttttcctagcagccaaattgttttgagactattgctgtgacctggagacatgagatatatttactgactcatcttgcacaagtactacaacaatgtgggttaaatacaattctctagattctagccaccatttacatcacttttcacccggaagaatgtattgtgtctttcaaatatctgacttataagatgacttttgcaatatcatcttttgtaaattgagggtggcctgtaacttggttgccttagcaacaaattggactgaatgttaacagttgagtccagatgttcattccaggcagacaagaaaacacagcctggtccactttgaaatgcactcatcagtactgcccacatcagtgtttgacatggttctcagatgcctcatgttgtctttaacccaactcggagccatgggcattacccgtgccagattacattttttctttttactaaagagacagcaatgtggagtaaaactgatcattgatttttaaggcaaaactattccagtgtctaattcagggacatcatttaaaaaatcatatgggacttccatatgacttttttttcatagcaagcatgaccctagacaagcacagttgattggttgattcaactattttgataatttttattaagaagccatattttgctaggtcctatgctatgtcctagggagatgagtctgttataatttcttcccttgaggagttcaagcctagagaggagatggtatttaaatgacttctacatttgtgagcaaggacaaacaaagatatatgcgaaactggggagtccaggggacaacagaactatctgtctctgagtaggtcaggaaagacaccaccaagaagccacatcttgctggataaggtggactgtgcagggcagagagagtatgaaggaacatccctgcaagaggaattgtctttgcaaaggtgagaactggaagctcatggtgtattgagggaataccaagcacgcttgcatgttcaggaaaaagaagagaaaggaaaggtcttgttggtcacactaagtcctcaggctttagagaatggagttatggagggaattagagcaggtagtgtgacatgatcaaatgcacatcttggaaagttggtagcaaccttgaggacgagttaaagaaagacagtgaaacagtgtgggagtaattctacagtagggataagggatcgggtttttaacagatgaagctatactgggaaggaaggaaggaaggaggatttagtggccagatgtgggtttcgggaggagggtggagccgaggaccccctaggtttctggcttgggggtgttgggtctactttttaaccaggacaggaacacaggagcagggacagttttgataagcagataggttgacgcagatttcaatttggagtaactaaaaaatgtcaaaacagtaataaataaataaataaataaataaataaataaacaaacctttatttaaaaaagtctctatcgggatggacatcttaacgcattacaggtttaatgtctccgaagcttactgatttatcccccttttccctcactctccaccatctcttctgaatattccctgacaagataatatgcaaggaaagttctgccaactcaagacaatgtttaacgtaaaccttggcaggggttacggagttaggtagtggaaaaagtgttaataatgataataataatatttatatcatattccatagccttcaaactgcttctacctaattattttacagtaataatgtctgtaaggaaaatacaagcattattttttaatcagcactttgcagaacaggaaacacacacatacacacacacgaaaggcagccatagagcactgaagaacaagtgaacagagagccggaggtggattcaaacaccttctctgcagctgatgaacccaatgtgaacttagacattgttctctccgagccccaatcccctcctttaggaaatggggttagcagagaggatggcatgttgcaatggatgtgcccagtacaggcttaaccaaaggatgttaaatccccaggcatcatctctgtcactgccagcccgatcaccagccaagtggagaagacagatcactggaacaagcctaagccgttgaaactgattgccacagtgttacattgtaagatgttatcttaaatattttgtaactgctgctttgctggggaagcagggtgtcttggttttccagagctttctctctaccctactggtcacagctggtggacatctgtcctgtcctgggacaatcagacccttagtggtgggaatttgaaattggttcgctctgattctaatcaggctaagaactgttaggtggtctacaatggcacattctgccaggtgaaggaggggagcagagaatagagaaaagtgaatgaagcaagtttgcagagagagcacagaggtgtgggagatggggagagaaggacagagactcagagccagccactgcctcagtttctgttgtgggttttggttccccaaaacatccctgacttgagatttgtgttagccttatatctttccagcaaattgtcctcttgattaagccaggtggagtgggtttctgttatttgtaaccaaccaagcctgtgctaaaacagatgagggcctattttcagataattgggcccaagaggctggaggcgagcatgcaaccaacacatttgtgaaaaatgcaaagaaatttatatgatcattctcagaaagatgccctgtttgctcagggaggatagtgcagttaaaaaaaaaaaaaaaaaaaaaaaaaggaaaagtcagcgacagctaaagacttcagtattgagccagttctgaaaggcattgagactgacccaatgacccacatccaataatatgcggcatttacaagacagagagggaggcggtggtgtgggcacacaagaggaaaggggactcaacagtctggcttccaacaaagaaaaagcgataataatgcttggtgtggattgtaaggcatttaatctggaggaacttgcaggatttgtgaaaacatctgctgctactcatgccgctttgtgttttgctctctcagggggactgtggtttgggggtgtgtgtgtgtgcatgtgtatgtgcatgtgtgtgtgtgtgtatacacatgcgtgtgcttgtatatgttcatgcatgagcatgtgggtattacaaggaccactataacatctgattctgtgaattgttaaaatatacagctgacatatataaaaatggcacagttttaagaaggcaatcattatttaattattctcaatgcaatacttacggtagagaatgtagataatacataaaagaaaacaaaaagtcttagtctgattacccaagaaatcttaatactttcatgtgttacctccccccttttctttttcctactcatttttacatagtttcagtcattctaggtatacgatttttgcattttgcatatattgcttatattatttcgtaaacttgcatccttgattattgaacatccttatcaacatttttaatgactctaatattccatggtatgcaaataccatcatttacctaaacatttctctatttgttcatattccaatagatttttcttcacaattataaatgataccacaatgactagctttgtgagcacaagtgtttttttaaccctatgttggacttgtactgttaagcatatcacagataaacagataccttcctcaagtgcatcaaatagttactactactacctacatatgaagacaaggtgacaggttgtgtggatgagctttttaaagtatgtgggatttaaaatctgacctcatggttacatttcaatattggataaatgaatccctttctgctttgaagactttcagtcttcaattgctccctttaaaatgcaagcatcataataccttgggcaacagggaccaaaaccctcttcaatgaccagatctgtagacaaagtcctgtagaaaagtgcagggacttggacctgtgggtctctgctttctcacctccactcttcttctccaccacattcgctcacagtagtgatggttctgactttctaatctggccctatccaaacctgcctggttggtacaggtgacctattctcactactcgatggcttatcctgctgccttttgtacttagaaaaatactgggctcttttctcctcattctatgggagtctacctcctcacccctctaggccctctgggattttgaccccatttccaacaaaagctccagttcttcaaactcagaacttcattctgatctccagatcaacagaagccctggactcagctgagcttcttccacattcaaattcagacccgttcacccaagaacaagatatggttgagactggctagatattcaccaaagctaattcttctcctgggcacacagttggacaaagctttgcatgtagctgtggtcatatgtttgagttctcaccaatgaaaaagaggtggaagttactataccacttctaggcttgattcatgagatcctgtgtggaatccatcactctcctttccctggtcagccatccagaccctgcaggggacttgaatgccttaggggatgatgaagacaccaaataaaaagagcctgggtgcttgaatgactgagtaaagatctcacctccacacaccctccaacattcattcaaccatcattcttaaacaaaaattatggttttctggtcattatttccattttttgcctgtgccagatcatctattcttacagcatcaaatagaaaaatttgactacagggcacttagagaatgtgatgtggtggaaagaggccagattcatcaaattcaagctgtatgactttagacaaggccattctgctctcttggcctcagcttccccattagtaaaatcaagaggctagtctacattgcacataagaattctcctaaccctaacattgtatggatttgacaaattacaagaaaatttcaaatgtaaggaactaaatatgactgctatgtcttataattttcaaaatgtcaattgaaattcccaatatcaattgaaaatcccaattgaatagacatcttgaaaaacgtaacagtcataaacaacacaaaagccaaagatataaaacaaaattggataaaaacaactgaagtatgagattttattttttccagtagtgagattaattttttgtcatgacagataaatgagacaaaagtaagcatgtgaatagagggccaattaattatatatatatatatacacacacacacaaatatataacatatcatatagcaccattatgcactaaaagaacttgaagtcctatgaatgtacagtctttatgtccttagatataaatataaatatatgtaaatttatatatacaaattgttcatttggctaaaaagaaatcatcatacattctgttatacaagtgatttcgcaggccacatttcttttttttttctttttttttattatactttaagttctagggtacatgtgcataacgtgcaggtttgttacatatgtatacatgtgccatgttggtgtgctgcacccattaactggtcatttacattatgtatatctcctaatgctttccctccccaatttccccaccccacaacaggccccggtgtgtgatgttccccttcctgggtccacctgttctcattgttcaattcccacctatgagtgagaacatgcagtgtttggttttttgtccttgcgacagtttgctgagaatgatggtttccagcttcatccatgtccctacaaaggacaggaactcatcattttttatggctacataatatttcatggtgtatatgtgccacattttcttaatccagtctatcattgatggacatctgggttggttccaagtctttgccattgtgaatagtgccgcaataaacatatgtgtgcatgtgtttttatagcagcatgatttataatcctttgggtatatacccagtaatgggatggctgggtcaaatggtatttctagttctagatccttgaggaatcaccacactgtcttccacaatggttgaactagtttacagtcccaccaacagtgtaaaagtgttcctatttctccacatcctctccagcgcctgttgtttcctgactttttaatgatcaccattctaacttgcaggccacatttctaatcataatataattcaattaaaaagaaagccttaacttcttggaaactgaaaaactttatcttaaatacacagaccctagatcaaacaggagatccaaatgtaaattataaactattttaaaaataatcaagaaaaagagacaatttcatgccaaaacacgtggaggcagctagggatatatccagagtaatgtgatccaagcatttcaacattacaaattagaaaaaaaggaacaaaataacaaaataaaattagaagaatataagagctaaaaataatgacattattttctttttagcgaagtaaacaataataatgacataaagaaaaaacatgtatctaaataaaatcaaaggtcgtcctttgaaaaaacatggtacatttggtgaagcaaatgaaaataagagagtataacatattaaaaaagagaaaggtggtataaccataaatagacaagatattaaattttaaaatattatgtataactctgtaataagaaatttgagaatttcgagagtgataatttttctagtaaataaaatgaaattcaaccgaggagaagaaaatcacgtaacagtttaagaaagttatttaaatacctttataaaaaccacctcaggtctagatccttttttttccaaatgattttaaaaatatatcctttaaggaaagataactctgataatatttaaattatctcagtccatataaaaataaagcttttccattcattttatatatccaacataattttcatgccaaaacaggatacaaataatgcaaaaataaaactagagataaattttacctataaatacagatggaaaatgttaaacaaatggaatcaatcagtgcatccaaagtacaaaccatgactaagcaaggattattctaagcatggctcatcatcaacaaatatattaagacaatgtattacaaacagaaattaatgggaaaagccatctggttgaatcaatagacagtgaagtgacatctgttattgtgccacccagtagctattttcccttcttctggtgactgataccaaagctttcctctgggaatccacctgctcatctcctttaagcagatgtagaggggatgagatcctacccagctcaggggtgaagcttgtgatctacatttgagccaatcagcacatcacatttccctggtcttaatgattgtgatttagaggtaagactatgggcgtaccaatcagagagatgcaataaaatattttctgggagccctaggaatccctatctcttcctctaccactagatttgaagctaaatgcttacgagttttacagttgttgcagctgattgaggggccacgggggaagagtctgtaagagttacctgatcctgataacacagtttgaacccttgtatcaagctggtctcaagccagcctcattctgagcattttcagttataaaagccaatgcattcacttttcactggagtcaatttgggttaagatttcctggaatttgtcacagaggaagttttcattgatgtatatgccaggatacatttgataaaatccagtagacattcctaatgaaaactttaaccaaaacagaaattgatgggcagtacttaaatataataaagacttttgaaaaaaacttcagtgaaccccttattaaggggcaaaattctgaaaccatttcctttaatatcatgagcaagacaggtatgcttaccatctccatttctatttaacattgttttggtggttaagccaatgcacttagtaaagaaatgagatactcaggaaaaatattttaaaaagaagagacaaaatagaatttatctacaaatgatgtgactctaaacttaaaaaacttgagtgactacttaaaaaatgtctagaatttatccaggagctgataatttggctagaatctatctaagtacataaaaaatcaagagcaataataaaaaaatcagaagaaactcccaatcataatgtgacttaaataatatgagacaaggaaaaaatacatttgatgggaatggttctaaacttaaaaagatattaaaatgcaaacaactaataaattttattgaaacatataaaaacatgtcctgaacaaattttttaaaataccacatgtatgaatgagcaaactcaatattataaatgtcagtcttcccaaaaccaatacgttgatgaaatacaatttcactcagaatcttcataattttaattcataaaattaactaccaaactattttaaagtgtatatggaagagtatatgtctaagaaaaccaagaaaactgtaaaagtaggaggaaccacgatgtttctttattaagcttacaataaagtaaataaaattgtatattattggtccagaaataataatttagtagaataaaacagaaataccagaagagattcaattttatatgagtatatagtaagtgacaaatatggaattttaattcagtaaaacccgtgcgtgtgtgtgtatgtgtgtctgtgtctatcttatttaaagaaattagattaatatgtaaggtgatgttttcttgataaaattaagaaaaagtaagtattctgctggcaacaaaattagggcatgcagtcagggaatctacaaggcatatgaagaatgatcacttcaaaacaactaacctttagataggaaactggaccttttgtgtgaaatctatcctgtgtttttttttttcctattaggataaaattatatattggctatacatgggtgaacagagaattaaacctgataacagaccaatccatcttgcaatacaaaaatgaaattataaggaaaaagattatctaactatctcggtctgccttctgctgctataaaaaaatacttgagagtgggtaatttataaacaacagaaatttattttctcacagttctggcatctgataagtcctagataaacagtggcagattggtgtctgataagggttgctctgcgcttgcaagatgtgcctcttattgggtaatcacatgggtgaaggggaagatagctccccagtatctctctcataagaacgctaaccccacatgggagggctctgccctcatgacttaatcacctcctaggggtctcacctcctaatactatcacactgatgatgaaatttcaacatatgaaacttgaaggaacacattcagaccttaccactgatagatctattaaacgtgggcttgttatcctgaaatagttataccattgcaatcaaaaaaagttagaacaaaatccaaaataatgtcaaattgaaggtattatttgtagccaggcacagtggctcatgcctgtaatcccagaactttgggaggctgaggcgggtggatcatgaggtcaggagttcgagaccagcctggccaatacagtgaaaccctgtctctactaaaaatacaaaaaattagccgggcatggtgtctcgcgcctgtagtcccagctactcaggaggctgaggcagaataattgcttgaacccgggaggtggaagttgcagtgagccgagatcgtgccactgtactccagcctgggcaacagaacgagactctgtcgcaaaaaaaaaaaaaaaaaaaaaaaaaaaaaaaaaaaaagtattatttatacaaactgatatatcaacaatgtcttgcattataaaagtgccaataggttgctggaaggcaaaatatttgaaaggtggagcagtctgaaataaattgtgtctctattttgtttctgatgtagttttagaagaatgttaaaggaaatataacggaactaagatgatgcaaattagagtttggttggtcccttcaggaaagagtttggcatggccatgggccaaattcaacctttgctctatctttgtaaagttttgttagaatatagcaacacatttttgttacttaatgtctatagctgctgtcatactatctacttggcttaaaagaaaacttgtttaattctagaaatggagcagactgcagtctctgagtacaactcagtaaatttaaaaagaaatcatgaaagtaagaacaaacaaacaacccaaaccacttggaaaaaaaggaaaattttaaatatataataaaaatttgattcaaagaagtcaaaatctcggtttgttccagaaattttgaaaaacaacggtaactatgatgtttcatgcaaaaacttagggaatactgccaaaactgcatatttcattgtttcattacatataggaagggtgaaaataaattattgaaagcatttaattcaaaaatattggtgaaaaaagcataccatgaaattctgaggtactcagaaggaggaattaataaaagaaaagtaacaaaggagtaggtttaaaagacatattcagattgaatttgttggaaatcaaacatatttccatctagataataatgtagatgagccaacagctaataaaatcaataaaaatagaaatataaaaatatgtacaaatgcacctaacagcagttacataaaacgaaacaaaaatacaccaccaacaaaaatacataaaacaaaactgagaactggaaagagaaatatgaaaatccacaactatatttgaaaactttcctctcccagtaattgatagaacaagtagagggaaaattattaaaattagagaaaatctgagcaaaacttcaaccacttgacctaagtgatgttatttcagactccattcaacaacagcaagatatacattcttttcatgtgcccctggcaaattcaccgagatagaccatataccatactatgaaacaaatcctaacaaatttaaaagaacttcaataacaggaaatgtgttttctgactatagtagatttaaactaaaaattaataacagaaagatatctgaaaaattccccaatatttgtaaattatacaaaacacttcttaatccatggatcaaagagtaaatcactagaaaagctaatgcacattgaattgattgaaaactaaaacgcatcatgtcaaactatgtgtggcagtgggatacagctaaagtagtacttagaggtaaatttatggcagtaaaatacttatattagaaaacagaaaagttctcatatccataatttaagcttctaaattaagaaactagaaaaagaagtacataataaatgtaaaggaagcagaaagaaggaaatactaaaggtaagaacagaaatgagtgaacttgaatatagaaaactaatgaaaacaaatggtaaaatcaaaagctgattctctgaaaagatgaacgccaggcatggaggctcatgcttgtaatcccagcactttgggaggccgaggcgggcagatcacttgaggccaagagtttaagaccagcctggccaacacggtgaaaccccatctctactgaaaatatgaaaattagccaggccaagagtttgagaccagcctggccaacttggtgaaaccctgtctctactgaaaatacaaaaattagccaggcatggtggtgtgcgcctgtaatcccagctactcaggaggctgaggcaggagaatcacttgaaccagggaggcagaggttgtagtgagccgagatcgcaccattgcactacagcctagccaacaagagctaaaccctgtctcaaaaaaaaaaaaaaaaaaaaaaagaaaaaagaaaagatcaataaaactgacaagtctctagccagactgatcgagaaagaaaagaaagaagacacaaatcgttagcatcgagaatacaaggacgaacattactacagatctttgagatattaaaaggaaaaataaatattagaagcacttaatgccaataaatttgatagcacagatgaaataaacaaattatttgaaagacacaaactaccaaatctcactcaagaattaggtaacgcatttcaccaagaaaaatccatatgaaaacagtttcactggggaattctaccaaatatctacaaaaaaaaaaatagtatcagagaaagaatagtacttttaggaagcagtgcttaaacagatatccatatgtaagaaatcaacctagacccataccttgcactatatataataatcaactcagaacataacataggggaaacattttgtgacctttgttaggccaagaactttgagatatgacataaagtacaaaacaaagaaaggttgattagttgaaattcattgaaattaaaaactcctgctcttcaaagggcactgtcaaaaagataaaaagagatgtcacagacagggaggaaatatatacaaaacacacaaatgtgataaatgattgtatccagaatacacaaagaactttgaagttcagtggtacaaagacagttcaacttaaaatataggcaagcagtttgaacaaagatgtcatcaaagaagatatgtgaaggacaaaaagcacatgaaaaattcccaacagcatcagtcattatggaaatccaaattaaaaccactatgagctctaatcacttacacactcacctactcatgtggccaaagcaggggaaagggagacaatgagaagtcctcacaaggctatgaaatgactgggactcttcgatacagtgcaaaatggtacaaccactttggaaaacagttaggcagcttcttataaacttatactttacatataacccagaaaatcaaatcctggatatttatccaagagaaataaaaatgtatgtctattcaaagacttgtacacaaatattcataacagttttacctatagtagacaaaactgggaacaacacagatttctatccatgaatggatgaactgtgatatattcatacaatcaaatactactcagcaaataagaagtaaagtactaatacatgcagtagcgtggctaaaccttgacagcaagatgcctcatgaaggaaatcagactcaaaaagctgcatcctgtgggatatcatttacatcacattctagaaacagaaaaactatagggacagaaagcagatcactggttttcagggccgagcacagggaagaattaattttaaaggggcatggggaaactttttgggattatgaaaatattttttatttcaatagtggtagtggttatacaactatacatttatcaaaattcatttaattttcctcctagaaatggtacattttattatagataatattttttgaaacttaaacacatacaaaattatttatttgggcaaacaagcagaaacaaagatgacattagagtgatacggcacgatatttttgcccaaccctaccaccattttatttgaaaacctggatggatttccaagaaaccacaaatgaacaaatttgactgaaaacacatggaaaagctaaataaatcaataatcataaaatgaactaaaacacataagaatatcaagaatatcccagtggtttgagtgcttctcctatactctccccaaagcaccaggacattcagttttaggaaagagtattttcattcctttaagaaaaaagtaattcctatatccatgaaatggtactaggacataaaaagtgaaagacaatttaggaattcctttttaaagctactctcacccccatagcaaaacttaacaaaaggtaggcttaaaaacccccaggccaatcttacttatgaatatggacgcaaaaattttaaattaaatattgttacttgagcagctcaataaaataccatatcttatgataaaatgagatttatttcagctgtgcaagatggttcaatattagaaaatgtgcattcatgcattaccacattaagagatccaacagaaaatcacctgatcatttctgatcctactggtttatacctttcccaagatctcacatggctcaccctacaaggcattcaaacctcactcaaagaacacctccacagagaactagccttcttgaactatctttgatatgtcaccttcctaccagcccagaaccatcactctccacgagagtagagactttattttttgtttgagacagagtcttgctctgtcacccaggttggagtgcagtggcgcaatcttggctcaccgcaacctccgcctcccaggttcaagcggttctcttgcctcatcctcccgaggagccaccatgcccggctaatttttgtatttttagtatagacggagttttgccttgttggccaggctggtcttaaactcctaacctcaggtgatcagcccgcctccgcttcccaaagtgctaggattacaggtatgagccactgtgcccggccaagactttgtttactgtctacagaatgcctagcactactcaaccaatacttgatggatgaatatcagtagatattgacaagggttttaagaaattcaatctctatctatgataaaaggcttggtaaaatggaaacaaacagctactttttaaaatgacaaaagagaaaagtatctcatatccaaattttgctttctgtttaatgttgaaataatccaagcatttctattagattcagaacaaaacaaggatgtcctctattccagatataagtgccaaagcaattaaacaagagactgaaataaaaggtatgcctgtttttaaaaaggaggtaaaaacagttattatttgcaggtcagccttggtgaatcagctgaaaaactattagaaaataaatagaagatcttactaagggagctggttataaaattaacatgaaaagccagtagcttcacaatgtacaataaacagaaaatgcaaaggaagtaatgatcagttcaaaaatgtaatgcaagaagaatcctatacataaaagtcatcagaaaaaataatctaggagcaagtgaaactagaaatctgaagtacctatgtgaataaagctatgaaattctactcagaaatatgaaagattttatgaagtcagaataaattcaatattgtaaaggtatcaattcttcctaaattaatctataaattcaatgcagatagaatataaatccagtaggatttctattgcaacttacagttctctcccacttatctggaaaaataagtgtgtgagaatatccagaaagtgtttgaaaaagatagcgggagatagatctatcaaatattggtaatgtattggaaaagtacagaaggtgaaactgtatggtaatcgtgcagaacagcccaacggaaaatactacagaatagagtccagaaatagaactgaaggaacatgtaagtaaaaggcagcagtagagcctagggcaatggttgggcattaggttcaaatcccagttttgcctcttcttgctatgggaccataggcaagttgcttacttttattcatttagtcactgattttagagaagggtcttgctctgttgctcagggtggagtgcagtggtgtaattatggctcactgtaaccttgagctcctgggctcaagtgatcctcttgcctcagccttccaaatcagctaagactacaggcatgtgccaccaagctcagctgggctttttgtcttttttgtttgtttgtttgtttgtttgttttttgtagatacggggtttcactacactgcccaggctgcttttgaacttccagcctcaagcgacagtcctgccttgacctcccaaagtgctgggattataggtgtgagccaccatgtctagcccagttgctctgcctttctggaaaacattgttctcctgcatggtagtggggaagaatagtattataataatagtaatgacctcagatggttttgatataattacatgaaataatctataaaaatgctagcataggacttggcatttaggaaatagtcaatacatgctagcatacatacctgcatacatatatgaaattcttattttaagtttgtagaggaaagaagttgttagcacaactagttagctatcttggacaaagtgtgtacatgggagtgatgctgtatgaggatggtcatctccatcattatttataggggtgaaacattattgatccacatgactaagaaaaatgaacataagagacctctatatattgatacaaaaagacaatgttatcttgttgagtaaagaggttagaatgcaacatgtatatagcacaaacttgcaatgtagaactgtgttcataaatctaaatgctttctcttcctgtagtgggttgaatggtgactcctaaaagatacatctgctcagaacctggaattgtgatcttatttggaaataggctctttgctgatgtaattaagttaaggatttcaagatgagatcatcctggagtagggtgggccttaaatccaatgacaagtgtccttataaatggagaagaggaaagacacacagaggagaaggccatgtgaagactgaggcagagactggggtgatgtgtcaatgacacaagggaagccaagggtcactgcagttaccagaagctagaagaaaggcatggaacaaattatccttctgagcctgcagaagaaatcaagcccgcaaacaccttggttttagacctctgacctccagaattgtaagagaataaatctctgctgtttgaagccatagggtttgtgataatgtgttacagccgccacaggaaaaaactgtacttcccaacatcatcaaaccccagtatttatctttgaaaatccactcgttcacctcacagttcagtttctccctacctccaaggaccgactggccttctatttgctgcccctaagttaaatagaagaaattgtttgcaacctggccctatgcataattcatggctgactctggctgtatctgctttgtcagcttttgatctcctggttaaagagataaaggtgttatctgtattagagtaacagtgtccaataataggggattgggtaagtaaattagggtccatcaacttgataaaatattacatagtgactgaataagataatgattaagacaagcaatgtggaaaaaataaggtctttgacataacgctaagtggaagaaagtatgttatcagattgtatctacaatataataacaaccaggacaaaattcttcctagatgtggacaaggacttaaaacaggtggatatgttgggctgtgggactgtgggtgtttcttcttccatttagagtcttagaaatgctattataatggtgtttgtgctatagtaaaaatggaaacaaaaaaggcaccaaagcctacagtttctcacagggtgcatagaagctggagagggagaaaggatgccctatcatctccaagtaaagggccctgtacagaagctctatcaaactttgtcctaatagagaactgggcacctccatttacagtatgaagtcttggatttttgagtaatgattcaaattcatttttgaatgaagctgaaattcctcttggcagattccaggtaaatgcaaacactggataagatacaatggcagacaaaataaccccgcacctcagcccttcctatgacctggctttcttggattttacccaagcagcctcctgccattctcttcccccaaccctatatatatgttgttcttcatggagattcctccctatttcctgaacatgccttgtttcgttgtttccctgcaaacacaaaaagaggctacccctatattccttctcctcttttaagttagaacttaaatatatattttgctgggggagacaaaattcaatcctccaggagagtaatctccctggaatttttagggagaaaataaaaggaaaataacagttagagaaaaataatgaaataaaaaaaaatggacaagctaatatctgttttaaaacttcattcatactttgaagcaaacatttactgtatctagcatgcccaagatgaatgaataatatgaagatgaggaaggcttgacatttatttgtctatttatttattcattttttagagtcaaagtctcactctctcacccaggctggagtacagtgtcatgatcatagctcattgtaacctcaaactcctgggctcaagtgatcttcccacctcagcctcctgaggagttgagatgacaggcatgagccactgcacccagctaatgttttaaaagtttttgtagagaaagggtctctatatgtttcccaggctgctcgacattttttgatcccctacaatgttccagaagttctcacacataagctcattttatcctcagagtgacattcaacaggtatttgtatcccctcattacgcaaataaggaaactgaaatttgtcaagtgagcaattgaagtatgatttgtctggactgaaacatgctgtaagtggaaaatgcacgctgtatttcaaatcttagtataaaaagtataaaatatcttgttcatatttttatattaaattacatggtcaaatgatacaattttggattacatattactaaaactatacattattaaaataattttacctgttttttaattaaatgcagctaatagaaaattttaaattacatatgtgactcacataatgtttctactaaaaggtgccagtctaaaatgacagaactgagaatgatgagtctagcttagactctggctcagggctccaaaactgaccacattatcagccttacttaggtctctgcctccacagcaaggaccatgagttagaaaacaatgtttcagaaataacacataaatagttaacaactacatggaaaaaaatttaatctagccaataatcattaaatgtgtggtttatggctgatatgtgaaagacaataggaagatgaccaatagcttgcactcaaaatcaatgtccaaatcagagcagaacagagagacgcaaattacctggacacaaagatgggttcccaggctctcaggtatgtactgccgctcagatctggagaggggtagggtattcagccaggaccataggggccgggtcatgttatgggaaatccctgctgcagcacataccccagtcttgaccacaggagaggctgtcctggctgtaggacaccctcccccggcggaggaggaagctattaaagatgaatctcctatctcctcttgcctttgagaaagacttcccaaatttcatacaagctgcctcccactataagtaaaacatcagctcccagaggagagagatttgtctgtttggtccatcagcgtatcccaactgcatagaacagttcccagcatataatgagtgttgaagaaacactgaacaaatgaactagcaaatgaatgaatgggttgatttccccccacagggtgctgccaatagtgagacactgtaacagctacaatgagcctggttttctctgtgacgacttttgtgtgtccctctgatgcatgaggcccctgactttcagtgtcagtgttccaactgtacacataggtccatcccacccaatatgtggccaagacagaggttgagcctggctcaccagggctggaataaagttcaagctcagttgcacatgcacacaatttgcacgagcatgagggaaagaggggttcattgctttagcaaagagtgaagagggaggagcttcaaggtgcctacagtaccagggcagcaggggaaggttagattttgggggaaacatgaacagatggcttcctctattttagcatgtctctgctttgaaccacctccttttcttagaactttgcctcacaactctaagactcccctccaggcaatagtactttctggcatgtggtttagatgttaagcactgtggatgctggaacttgaggctggggtaaggcagctttgagtactccttttatccccctcatgccctcttttcttctccctctcctaggatttcctctcctccagccccttccctacctccctggttctggttacttcctcctataatttctgtcctgacagtagaggatcacctgaagaccttctgtacctgtgaagtgaccttatttgaaaataaggtttttgcatctataatcaagttaagatgaggtcattagggtgggccctagaccaatatgactggtgtccttataaagagcagaggagagacactgaagagacgcacacctagcgagaacgccacgtggagacagaagcgagactggagcaatgcagccacaagcccaggatgccaaggattgctcataacagcagaagctgtgaaaaagccacggcacaggttttccccaacagccttcggagggggtggggacctgctgacacctcgattttgatttctgaattccagcctctgagactgtgagagaatgaatgtctgctgtctaaagccacctggtttgtgatgctttcctatggcagccctgggaaaatcatatcgggttgctatgtctgtctgtcatcagttatgacaggtgacttggttaccaacaggcacaatttcaatgagaaaaagtgaaccattatgtaaacacatttatctgagggcctgaatacgactgtccaatgcctataatctctgagtttggggttatcatgaaaaaggaatgctgaactcgttttgactcagataaatgtctgagctccggtgcttattctggccgtgcaccacttcctcaaccccacacaaatgcttctttgctctgattgcaaacaaaatgcatgcttgttagaaaacccggagagagagagagaaaaaacaaacaaatcataaagggaaaataatttgcctcccttctccttacgccaggctaatcactgttgatgttgtgttatgttctcttcctctttcctcattacgctggtctcacaagggattcaactcaccttgctgtccagcacatactcacttggttactgatgtctgagccactgatgtagtcctcacagcccccaccttttgagggggattctggtctgtcttcgtctgtccccagagtgtgaagagcccaataaattgttagtagttaagcaattctgaaaccaacccctaccaacatgggtctaggaccaacccccgccaagacctcacaacatttgggggtgttgcagagaacactgtagtggggtttgggaattgctgcggataagtgaggcagctatggaagaagcccctgtcagtagttgaagcaacccagagtgcacttctgaaccttaggaaaggattaggattggtgacaggggatttcaccactgcctcttttgagtttaaaagctccaaccttgccctaagtcatgcatagctcacccagaggtgaatcatattagcccaggtgtctgttcttggttgatccagaactgcttcttctttatcttttaattctccttggaatcaggtagatcccatataaaccctcaaaaagtaaagtctgattacctcccatctttctgaaaaattagatgcagtctgcacttctcttctcaacgtaatgacatgtggtgtttccagcaagttcctgaccccctaacatacacacacacgcacgcacgcacacacacacacgcatgcacacacacacacacttttttaaaggagttgccaagtgcagcaggttgggtggcggtctccaaaagatacatctatctggaatctgtgaatgtgaccttatttgggaaaagtgtggagaaagggacaacaggcaggagattatcacagtcaggacaagaaaccaggagacgttgacagtcacgactaaggtggtaggagtgaagacagagttgtgggatttcagggacatgtggaggtagcacatgagggtgatgggctgacagggtgtgtgtgtgtgtttgggggaggagagcagacagtgctcatggataagacgagtcaatatcattaaaattgccatactacccaaagcaatttataggttcaatgctatccctattaaaaggccattgacattcctcaagaaactagagaagaatattttaaaatttatatggaaccactaaaaaccctgaatagccaacacaatccagcaaaaagaacaaagctggaggcattgcactatccaacttcaaactataccacagggctatagtaaccaaaacagcatggtactggtacaaaaacagacacagagaccaatggaacagaatagagaacccagatataagaccacacacctacaactacatgatcttcaacaaacctgacaaaaaccaagcaatgtgaaaaggattccctattcaataaatggtgctgggataactgactagccatatgcagaagactgaaactaaaccttttccttacaccatatacaaaaatcaactcaagatggattacagacttaaatgtaaaatccaaaactataaaaaatctggatgacgacctaaccaataccattcaggacataggcatgggccaaaatttcattatgaagatgccaaaagcaattgcaacaaaagcaaaacttgacaaatggaatttaattaaactaaagagcttctacactgcaaaataaactatcaacagactaaaaagacaacctacagaatgggagaaaactttttcaaactatgcatctgacaaaggtctaatatccagcatctataagaaactgaagcaaatttacaagagaaaaaaaacccatacaaaagtgggcaaaaaatatgagcagacacttttcaaaagaagacaacaggcggcaaacaaacatgaaaacatgctcaacatcactgatcgttagagaaatgcaaatcaaaaccaccatgagataccatctgacaccagtcagaatggttactactaaaaagtcaaaaaataaacagatgctagcgaggatgtggagaaaaaggaacacttatatactgctggtggcagtgtaagttaattcagccattgtggaaggcagtgtggtgattcttcaaagacctaaagacagaaataccattcgacccagcaatcccattactgggtatatacccaaagcaatataaaacattctattataaagacacacgcatgtagatgttcattgtagcactattcacaatagccaacagaatcaacctaaatgcccatcaatgataggctggataaagaaaatgtgatacatatacaccatggaatacaatgcagccataaaaaggaatgagatcatgttctttgtaggaacacagatggcggtggaggccattatccttagcaagctaacacagaaacagaaaaccaaataccacatgttctcacttataagtgggagctaaacgatgaaaacacagggacacatagagggacacaacacacactggggcctttcagagggtggaaggtgggaggagggagaggatcaggaaaaataattaatgggtactaggctgaatacctgggggatgaaataatctacacaattagctcccatgaaaaccttcacttgtacccctgaccttaaaagtaaaaaaaaaaaaaaaaaaaaaaaggaagagaaagactaataaaagaatcagaaatgagtcaatttctctgccagggacttttgcatagtatccctttccaccatgtggcaaacttcacagagtccttgttagtctccctgcttataggctaggtatcaggccccagggaatgacacgtcacccagggttagtggcacagttagactgcatttcccttttttatgtgattctttgcccacaacccttctaatacaccctcagtctggccccaactctctcagcctgtggcctcatcctgtgcccaggcccctcactggtctcagccttcttccagctgaagcctctttatttccagcccctttgatcagagcttgggttgatgcaatgcaccactctaggggaagcataaacccagaaaaacatcagggggttgtgctgttgacatcacaatcataattctggaaacttatttgaaggaaataatttaacaagacaggaaaaagcaagttcataaaaatgttcatggaaacctctatgattttccataatggataaatgttagaggctatgtgaatgtcacataaggtagttaaataaatcatgatagtgtcacttgatgggacagaatgtggccattaaaatgctaacaatgtaactatgtatcattttacatgaggaaaaagcatttaaaataataaagatgcaataattacagaaaaatttcatatgtatatagacaggtactaggagaaaaaaatgaaacaaaagtaagattctgagtaactgataatttgttttctgttactacattttataaatataaacaactaactttttaaaacaaatttaaagcttgtgctaaactgtgacttagcccccagtaaatctctatttatttggcatctgctaaaagaaccaaatgctcttgagatgctgatgggaccaaccttaaagcatttaggttttttattttttattttttggcccttaaaacatttttgttcttgtcatgactttggacactcaagttttccaaacctcaaaaaacaaaacctttttgtccccagctgaaatccaatgtcacaggtgcactttctctgtgcaaaaaatactcccaatttactgacagaaacttaaagcccagattgcagctttcaaggttactccaagggcattgttatcctaggacccatatgggtcaggctgtaagtttcctaccagtggattccagagccttgggcagagaacaccagagctggtagtaaacaccttccacctgcctcccactctcaaactgagggatacttgtctgagggggctcgctgtgcctcaaaagccttaaacagcaagcaaaatgagcttccctgtgcctaatttgggaatgatttactcatttacacaagcagctcaagtttggtacaattagctggtgtaattggaagtcactgtctatgaggatggatgcagcagcccccagaccacaccaagtgcagtgaaattacagcaaattgcagtgctcctgggcactgtgaaacagactttgccatagcagccatggcacatctttttgtcagatgagaacacaaatataaaacagtccttagcaacatctttcttcccaagacaagaacgcaagagggaatctaggatgcctttaaggtattatgtagggagatggttccagtaagaatcctgttaaagagagttgcctctctctgacgtatgcgtggaaaaagatggatttaagcaaatagacacggctgacaaaagtgtatggaaaaagaaaacaagaaatgctttttgttttctatatttctttgacattacggaatttactgctcagctaaaataggacaggttgagggggaagaaaggccaattctttctttgtgagttacgtattatgagtaatatgggttctgtattactcaaacatccagtatgcatccactctctgctaggtactcttctagatgtctgggaaacattgatgaacaagacaaaatccttgcctggagcgtgagatgcacacaagcaaacccacacaaagattactataacgcaatgcagtcattgcaatgacaaaaatactccagaatgttacatgaggggggtgcataaaccagttagaggaggtgagatgaagtctctttgaaaagaggtaatgcccattctactcggtgacttataagtttgaatttttaagttccaaatgtaagtgaaatcatgcaatatttgtctttccatacctggcttatttcactcatcataatgtcctccaaactagggggtgaagaaaatggggagatcttggtcaatggatgcaaaggttcagttatgcaagatgaataagttctggggatctaatctacagcatggtgaccatagttgataatattgtattctatacttgaaatttgctaagagagcttattttaagtcctctcaccatgaacaacatcataactatgtgaggagatggatatgttaattagattgattgtggtaatcacttcacaacgtatacatatgttgcacaccctaaacagatacaatttttatttgtcaagtacacttcaataaagctggggtaaaagagaggtaatgactgagatgattgaggcaagcagacattatcccagcaaacagccagtggatgagagagggaggccttgaaggcaaatcagcgttatcaatgtgcaaagaagtacaaaggtaaagaggagcttctggaaggggctgccaataagcagtttggtgctgccagaacatagaggtggaaaaagcagatgatcagaaagcaagctaaagaggtcatgaggagtccaggggtacccaaatgctggattaaagagctgtatggttcgtgaaagttgtctgtgtgtttcatagtgatacggataggagtcagggaaatactgggtagaagagggttccctggcaaaacccccaccctcaagcctggaaacccacagccctaaatgggaacaggcattcctcttttcatgcccaaatgtggccttttggctcaccacactcccctatcctgtacccatataaaacccaaaccccgggctccacaagcagacaaacagaagagaagaagagtaacagaatggcatggcagaggagagaagagaaggagcatccaaacatcaagaggagttcagctggggatgttcagagaggaaaccggctgctggatgaccaaaatccaggggaaggtcatcttcccactccatcccctttccacctccccatccaacctgctgagagccacctccaccatacaataagacccccacatttaccatccttcaagtccatgtgtgaactgattcttcctggacactggacaagaacccaggtactaagaggacactgaattggttaacacttaagccgtctgcagatggcagagctaaaagagcactgtagcatgcccactgaggttttgggagttgcagacacccacccctggatgctgctgtggggccagagcccaaaagtgctagcccgagctcctgcacctgcctgtctgtgagctccccctcccgtaaggggtttgaatgtgcacagtggctgaacggatgagtcacacccctgttgtgtgtcctgcaaggggggtcagggaaccctcttgtttcaataggttggtcagatggctgatgtggagggtggatcttggagaaaggaccaggggaagccagcaggtgatggatgcaggagtcctgagaatttgagatcccaaccagggcaaaggtaggagggcagaggtcagtgcagacagatttgccacagtagctgtcaaacatggtggcacaagagactcctctgggctccatttataaatatttcctggccccacccctgaagtttctgattcagtagcttttagaagaatttggatctgcctgtcttttaagcctccagagctttgaaagctcagtcagatttgaaagccattgatttagaaagtaaaatccatccctcctcttctcccccattcttttctttctgtaacagtctatttggcacctactgcatggcaatactttactgaggttaagaagtaccatgggagttaaagaatacacaaaaagggaaggtctttcatccttttaagtgtttctcaaacttaaaaacttgttagcctgcaaacctgtaaaacttataaaatctgtcttagtttgggctgctataacaaattaccacagactgggtaacttataaacaacagcaatttattgctcacaattgaggttgggaaatccacgatcaaggtgcctgcagattcagtgtctagtgaggttttgttcttcatcgatggcgccttctagctgtgtcttaacgtggcagaaggggtgaacaagctccctccagcatctttcataagagcactaatcccattaataagggcagactcctcccaaacatccaagcattttatcatctcccaaaggtctcacctcttaataccactgtcaggcctctgagcccaggccaggccatcgcatcccctgtgacttgcacgtatacatccagatggcctgaagtaactgaagatccacaaaagaagtaaaaacagccttaactgatgacattccaccattgtgatttgttcctgccccaccctaactgatcaatgtactttataatctcccccacccttaagaaggttctttgtaattctccccagccttgagaatgtactttgtgagatccactcctgcccacgagagaacaaccccctttgactgtaattttccattaccttcccaaatcctataaaatggccccacccctatctcccttctctgactctcttttgggactcagccctcctgcacccaggtgaaataaacagccatgttgctcacacaaagcctgtttggtggtctcctcacacggacgcacatgaaaaccactacattgggaattaggttttatcataagaattttggggaaacaccaacattcagactatggccacccccaggcataaatgtgtggacacctcatgccaaagggttccatagattacagttggagaaatgctaccttgaccatactaccacttacagtcactgggttcacccatcaacattgaggttatagaagcagtcatcctggtggcccaggttaggtttcttttcatttttctttttaaataattattaatttgaaagtgagaaacttcatgaactgccatggttcttgtttacagacagccctgtccattttgacatttctgtgcagatgtaagagacgaaattcttttttcaaaattgacttggtatgggaaacttttttccagtaatgaaaaatattagcccaacttgccttttgcaattttcctttgatgttgacacaccagacagtgcctatttgtgtcagagccctcccaaagccatcaggtcaagcatgccactcagcttcacaggaggggaaggatgggctctgaatatgtctactcagttgcaggaatgttcaggttgaatggaatttgcaaatacaatcatgacgatgaagtcacctccattgtgggcatgaaactcaactcatcccatttgttttttcccactcatttccctacacaagccttgttcatccaatactgacagggcacccctcctcaaggatttggcaattcaagcttgggggacaccatgtagactacatggtttccaagccaaggctagatccagacctcagtcaccctcttcattccaaaactgcgcctttactcctccccaccctacatctgcaagcttatggccaccctaatcaagtggattgatcatgattgggaaattcaggttaatttcaccatcatttattgagtgcctttggaaaaggcactgtggctaactagttaagtgggcaagctttgtattcacacttagtaggaatctaggttttgtttagtagtcaggtcatctcaggcaagtaacttccttcttctaaggctcagtattaaatggggatagtgatccttaccttgaagggctgagacaaaatgcatgatgataagcactctcagtgatacatggtaaagataatggggtctccatgggattcgagcaggaaatagacagataattcaagcagagttgactaaaggcactatttacaaccctgtgagccggttgagagaatcggggcagaggtatcgtggaggagtgaactaagtaagcgagagtgggaggggtggaggagggagcaggtcctagaacctgaaaggtcaccttgggaggagctgtgacctttctggaggggagaaagctgcagcagtcaacacccttcccttggtctcctccctctctcctcatcccctgcaaggcgctctttcagatgaacagaaggcaaggcaacacagtgatgtctgagactcaatctcctgtgccagggcacaggcagagaaaggtggagggaagacatgaaggaaggaagggcaggtagcagcaccactgccattcatggatgacctatcctatgccaggaagtctaagaattctgagccaagttgtagacagatgtagaaatccacaatcacagtatgggggaataaattctattataaactaacaagtaggaagccctcatccaggtgccgagggtcaaaatatgccccaaagaacccttgagcagggtgctgaggatgcaagaaaggaggaagagggaaaagatagcaaggggagtgtagtgtggctgtaatgtaaagtctgtgcatttgggagtggggatggaaaagcaggagagggaactgggcaagcccgcaagggctgagtcactcatggaggaaactgttggccaagttaaagaggaggttaggttttatcctcagagctgttgggatttataaggattttaaatggtacagtgtctgtataatctgtattttagcaaaatgattttggtctcttcagggagggaagtgttggtttctctgattctaacccatgagcaaggtccccacggtccacggtccagggtccacggtccacagatataactgggcaaggggaggaatttcacagcagggtgaggaaatcctgacgtagcaagagcatggttcagggaaagactggttccaaaactgaggctccagtaaatgttcctggcatgatggaaaatgcttggcctgcagacaactcagtactgtacgtgctgaacttcaacgtgcacagtgacaacctggggatcttgtaacagtgcagaccctgactcagaagacctggggtggggacagagatagcactttcctaaaaagctcccaggggatgctgataacagaagaacacagagaggttcagcttgagaggcccaactgcttcaacctcttcttctgcaggtaggctaacagaggctgtggaagggcatggctggtgatgtatcataaagttggtggcaggaactgtagaaacctggctgcgagtccttcaattcagagttcccatggggcttccaggaccctctgggagatgactggggaccaggcaatctacttgctattgaagggcaaaggggaaagggagtgaacaggaattgatgaggcaagagtgtctccagcaagtccttggagagtgcaaatggatctgccaacatgcatgatacgcttttcacacatcagcctgctctgagagtatcatgaaagctgacataaatctctggtgggctgccaaaggccttcttcccagacatgatgactggcataaaaactcaacacaatacttaaaacacacactcacacaggtgagatctatgtgcagtgcaatttggcaatatgtagcaagagttacaaaagtattcattccattcaacccagtaatttcatgttcgtgtgtgcggtgggggtgggagtgtctaatacacaaatactctaaacagaggaggaagaaaacgaactttgacattgaatggatactggacagctaggactacaatacattttgaattcttataatattcctgaattgtaggcttaatattgcttctcctacacacaattttattaaaccaataagatcattcaatttcagaggttaatttgcccaaaagtcagccacctaggcaacgttagatctaggatttgaatccaggtcaaccagatctgaaggtcatgttctttccaccatgatgcaatgccaccataaacatgaagtttatcatagtgttatcaaatatataaaaaataaagggatggataagaaaattacggtatatacactaatggacaattatgccatcattaaaaaagatgaactatttccatggttctataaaggcatcatgattgtgattaaacagttaatgaaaaattacaatagcaaattttatgtaattatagttaggtaaaagatgtgtgcatattaacaaagataaaatacaaggcaaaattagcactgtggtagaagagattataggtgatctttttctctgatatccaaacattctataatattgttataaaaattggccaagaaaggctaagataacagaatgcatttgttggtggggagagcagagagcctattgtacatacaagatccttaacgggatttcctacaaaatcttgagacctctgcacctggccttatcttcctgtggttctgcccttcagtcatgaagactctctagatgacttgctctaacatagactctctcacctctggcatcattttcaggaaggcttctatagctctggtctctttatccaagtggtaacacaggtaagcatcatcaaaaagaactgcctctcacaacagcagatagaacatttatacagtaggtgggaacggacacacagggcctttaggcattgcaactgacagcatggctgctgctgggagtgaagggctagtcttcaggggcatggctcataggatgaggagagagtagaactaactctatcttgttaagagacaaaacagctatgagagaagggagacgcccaagccatcctcagttcccaccttccccatgtcttcctagataatcgcagtctaagcctcacttaggacttgatacccaggagcctatggcaccagtctgcctaacatagcccttcctgggaggctgctgaatcaaacctgcttgcaagagtcttgacacattctctgcacctccacacacaggctagggtcttgctgtcactaggctgatcctcagagacctgagaccactgcttgttttcacttccaatatctttggtacttttgtaaactaaacgtaaaatcctaagctcccaaccaactgaacggacgccttcttggccaaggggaccccagagaaacctgaaaaccggaattcttggccatgggggaaaggaaatcacacgttactacattccctcccttttggattttaggcacaattgaccagcattaattttaaaacagactctttgtggcaatacaaaaccaaattatgaacaaggcctaaagtcatgcaaagcaagggttaagtcacagctgcaggccatcaatccagctacatagcatctttatcttaactgaaaacattcctttctgctgattccaagttttagacagagccttactcctttaaccaattacaaatttaaaaatctctgaatccacctataacatataagccctcacttcaggatatctcgtcatttggggccaaactaatatataccttccatgcactgatttatgtctttgcctgtaaatcttgccaccctaaaactataatccgactatcttgggcacactttctcaggatctcttgagactgttttcccaggccatgatcactcatactggctcagaataaacctttttaaaagattttgcaaagtttggcttttctgttaacacttttgactcaccatgttgagttcagtcatgagatgggtgggactctgacacggacatgtctggactttgctttaatctactggcaaatggaaacccagctgccgatgggggatacagtgtgtgggaagtttccccagaacctcacaccatctgctttatcttcttgttggcccataatgctgacgtccctgcagatactgcaacacagtccactaggattacaactgttgtgaaaaggattggaaactgcaacatgcttatactgcagaaaaaaaaagaaatccagaaattacctaattaccataaagacagattctgtaggatgaaccaatgagtgagggcagagcttcacctatccccctatcaaccttctgagaagaggccagagacagcaggcagggtataccttgcaggctaaccccattctgttggaaatgaccagctgcagtgctgtgccatgatgaaagggattctgaggccatgttggagtgcagtggaagagcatgccctgattgattattgatgtccatcatgggaatggtattagggaggagtcagggcacacacttgccctatattcatctccctctgctaggaaataagcaaactgaaattcaagttttaaaacaaggaggaaaacaggaccaccacttctaacctcgagtttatggatcccatccaaatgtgtatgtattgtttgactctcctccattagatccatgtctactgaacatagtgagctattatttagaccacagttctacaatcaatggaacgcatgtgaatgccactgcctgctactgaaaaatctattgagagggaaaaggaaagcagaaattcaaactctcctaaccagctgcttaaaaagatccagttcactcttatcatacccccaaaattatatctaacattctagtaagatcaatcaacacatcccgaataaagtgatttgaaagtaaatacggtccatatgttcagggaatggagagccattaaatggaataaatagattacacagaaatgagaatatgttgggcatagtgaaaattaaaaaaaaaaagtcaccataaccacgtcaaagctgttgcaaatgcacaagaactagaaagaaaataaacccacatgaagatggctagtgtgttatttccactccctatttttctaacactatatactattgttatattgtcactaacatttaatgaaaactaaattattttaaaaatcaagccatcatagcgatgtcgatatttgaatatctcttacgcctgttgccttaaccttgactcaagtttggaatgcatttttatttattaaacaaatatttattgaaccctattttgtgccaggatctgttctaggcaccggggatatacctgtgaatacagatctttaaccttaacaagtttatactttagcaaattaattctatgagttaagtataaactcactggtcactggaacctcatatagtctattagagattattataagacttgggacataatcttatgattttggatggtcctataaggtcatatatatggactaatggatgctaagagatacttctgttactctacctacgccttcaaagggatctcatcttcataagaaaagcccatcccatcttcataagaaaaaaaaaaaaaaagaggccaggcaccgcggctcatgcctgtaatcccagcactttgggaggctgaggcatgtggatcacttgaggtcaggagtccgagatcagcctggccaacaaggtgaaaccccgtctctattaaaaattaaaaaaaaaatagccaagcatggtggcatgtgcatgtaattccagctactcaggaggctgaggcataagaatctcttgaacctaggatgtggaggttgcagtaagttgagattgcatcactgcactctagcctgggtgacagagtgagaatccatctcaaaggaaaaaacaaaaaacaaaaaacaaaaacaacaaaaaaaagagaaaattttaaaaagaaaagaaaacaaaaagaaaagaaaaaaagcaccaccaaatttgagaccctattgtgttccaggtactaggtaaggtactgagttctttccagagatgagctatgtatatatataggagtgtgtgtgtgtgtatttatatgcacatacttgcttgtacatgtgtatccctatattgtgagtccctttgtttataaatgtgtgtatcccttggcacttacaatataaggctagacatttataaagaaataaaaaataattgtgaactgtggtccatgttatccaaaaatgggaagcaatggtagagacagtggtgagtgggcaaagccctacctgaaggctattaggcagggcccttctgaggtggtagcattcacatcaatacctgtagtaggagaatgagttggccatggaagaggaagtgaaagagctttctggcaataggaactctgcgtgcaataagcctgagacaggggcccctagcatgctagagcacagtaaaagaaggccagtgagaccagagggaaaaagagaatgggaggtgcaagtctttcagacctaaggtagcagtttggattttatgtgaaatgcaatagctctaaaattaaggtaataaaactatgagagatattaaagaaaacctaaataaatatacagagattgaatatcataaaatgtcaattacccacatattgttctatacattcaaggcaattctaataaaaacaacagatgttttcattaaacttgataagtagatactaaaatgaaagagccaagggcaagaataaccaagatattgctgaacaagtatgaggaggaggaatcttctctaccagagatcaggacactgtgaagctgtaataaatatgactatgcatggttacagtgcatggaggccagtggaatagagagctcagaaaaaaattcatgcatataagaaattttggcataagtcagatatggcctggtagagcagggaaggagagactgtaaaaaggacttggataaagtgtttatcaatgtaataaaaaaataaaattttcactccatctctcaccctatgcaaaaattaattgcagatagatcaaaaacttaaatttcaggagcaaaactatgcaacttttagcagaaatataggcaatcatctttctcaccttggtttagggaagaatttcttaaggacacaaaatgtgttaactatataaacaaagtgataaaattggctataattaaggacttttgtttttcaaagataccttagaagaagtaaaaacagcaaattacatttgtaactggcaaaatattatcaaaagtatattataaaactattacatatcaataaagaaaagagcatataacccagtagaaaagtaggcaaaagacatgaacagatatcccacagaaaatgaaatacaatattctacctcattaataatagagggaatacaaagcaagacaacaagataccattttatatctatttagtcaaaatgaagaatcttgacaacaccaaatgttggagagggtttgaaatcataggcactcataatttgctggcatgagtgtaaattagtgcaaccagtttgggaaagagtttggagtatttttgtaaaacttaacattcatttaccatctgacctagtttctagatagaaattcaggagaaaatcttgcacatatacaggagaaggtaggcacaaggatgctcatttcatcactgctgataaaggcaacattctgaaagcaaccccaatgtttatgaaaggatcatgagtgaaagttttgtagtatcttcgtgcagtggagtagtagacagcagtcaagatgaatggactacagctgcactcatccgtggggatgaacatttgcaatacaatatggaataaaaacgtcccaaaagcttatacacaacttaaaatcctttattaaaagttaaaacactaaaaaacaatatgcttataaggaattcacacaagtagcaaaactatataaaatatacaggaattatatacaagatttagaagagtggaggggtcaggaagatgggatggggagacgtaagtgagtagaaacagatgtgcttatgtagatcataagtaaatgttaggtgttgtcagcattctggttgtcttttagttggtgtgttactgaaaaattaatgagtaaataaaaagaaaagagacccatgcacagaccaatacagaaacagtttcatgaaactaggagtgagattaatctcattttgggcacccaagtgatagttcatagcagaaagagctttttgaatctccctggtccaagcctcctaagccacaaatgtggaaactgaggcccaggttgggaaagaagccaactagttcaagtacactctgcaatgactaaccaaaggtcaatcttaaatttactgtttgcacaacccactatttgacgtgcagcgatacacacgttaaaaacgtgcataaaataaaacagaacaagaaagcagtgaattttctttatgccatcttgaaggaccctggagacatggtatgtatgtatgtatgtacgtatgtatgtatgtattgaaaccataatgaggtagaccaagatctcatacttgggtgtcagttttaaggaattacttttctcttggtaaagagtaagaaaaagcagtcaaaagaaaaaatgcccattgacttaaggtgaggggagaaaaaccacctgctagctcccgagctaatgaaaagacaagcaacaaatcacagattggaattccagcctccagagacttcagaacagaggctccaaatgtcctgatgatagatgaaaatatgcaaacatttttcattttgttctgaccaaaacagaagcgaaagagccagttaaaagcagcaaattcatgctgcattgcccagcctaggcggaattccaacaggggtaacacggtaaaacatccgagatgaaaagagaacaacttgtgatgtttaaagagacacttcacaacttaagtgctgcctctgggcacagtttattgaaaggaccacagcagccagggagaaagttccatctctagccatgtggccatgtgcacagaaggacaccctacaaaggcctctgggtgcacacgcagtgcagcaaaatgcagtttccctcccagataagaaacatgaagaaagcccacgccctgacaaatgcagaactcactcttcatttccttcccttctctctcctaggacaactgtagatgcataggattcaatttaaccgggagacttttgttttaatccaacatttttctttagcaaaactctggagacaaattatggcagacgttcatgttaaacagctgggagcccactgaaatgaaagaaagtttctcccctggtgttaccatggcacggatatgaggtgatcacaggcccccctagtttaggagaaaacagacatagccctgtgtctctgatatctctgtcagttaactctccaatgaaatagaacaatcctaaggatgaagctggaaaaatggatacatcaaaggatgaaagcttcacacagacatgccaccaaacatacaattatatgagtgtatacatgtgacagtgtagaactacataaactcacaaaaacatatgctcatacacacaccccaagacaagcatacttattcacatgtgcgcagtgcaggaatatttttcatgcagcaacctttattgttttccacagctgaactgaatgattaatgtttactgtgaaaacctcactggcaggacaacatggtttgctatccttaggtaacaagtgctacacatctgttgatttccactgtcaagttacctggctccatcacaaatacctgtgtcgtaatagaaaagaagaaacaccccaaggcaaatacagaggcaatcctaatataccacaagtggatgaccagcagctctaatgcgaccaggtacataaatgcaagtcactcacatcagaatgcaacttcttttccttccagactctgagtgccagaaatcattcttttcaaccagagctgttgctactgaaacacctgtcagcttccctgtcagcccgaatgacctgtatatggcatctaaccagggatgcctgcatttttcaagtttctggaggggaaacatcttatggaggttgaatgatgagctgtggactagaacaaatggctcctagacatcccagggccctgacttttaagatttagggaaggcctctgggcaaatctattgttttgtgtgtgcacatgtcttttttaatctcacaaaaaaaaccacaacaggactgacttccactattcaggagagggaaaaagatttgcaagggaaggtctgtggtgggctctggcatcagagttgcaagatgccattagtaacatgcaaagggatattgacagaacgatacctccctatgtttcttcaattactccacacactgtttagcaaccttgagggaaaaaagaccaatgtttcttgaatttaatccttaaaaaaattaacacttagcaactgcctgtgtatgagtgagttggctgtagcgtaacatcagatagaggtggagtctggcagagtgagagtgaagataggttaagccaggatcaagactgggtttatttagaaggtgtttagctaggattacatatcagaggagaccgactggattcaattcatgcaatgcttcttcccaaccctggatgtttttaagaaattctcaaggaacttaaaaacaacaaacaaatacagcatatggatagcgccccctcccctagagattctgatttatttggaccgcaataaggcccatccatccatccctgcattcattcaggtaactagacgcctatttatttatctatacattgtttcaagctctcaaggtaggattttttgtttatttttgttttgtttttgagacagtctcgctctgttgccaggctggagtgcagtggcatgatctcaactcactgcaacctctgactcctgagttcaagcgattctcctgcctcagcctcccaagtagctgggactacaggcatgcgccaccacaagcagctaatttttgtatttttagtagagacagggcttcaccatcttggccaggacggtctcaatctcttgacctcatgattcacccacctcggcctcccacagtgctgggattacaggtgtgagccaccacaccaggccaaactagactttattttttcagatcagttttagcttcacagcaaaattgagcagaaggtatctcaaggtgtgattctaatcttcagccaagcttgagaacagctaaattagttagacaaaaataatcatcattgccccttgctaggatagagcacaaatccatacatttatccaaagaatatttattgagtacatactatgtgaaagctactattttaggtcctcaggacacactgaaaggcaaaaataaatatagcatatattagttgtttctttctttttttttttttttagacagagtctcgctctgttgcccaggctggagtgaagtggcacaatcttggctcactgcaagatccgcctcccaggttcacgccattctcctgcctcagcctcccgagtagctgggactacaggtgcccgccaccacacccagctaattttttgtacttttagtagagacggggtttcaccgtgttagccaggatggtctcgatctcctgacctcatgatccgcccgccttggcctcccaaagtgctgggattacaggcgtgagccaccatgcccggcctgtattagttatgtcaagaccaaatgctgtcaggctagagaactggggaaagctgatgttgcagttccagtctgaaaggcatcggctggggaattccctcttactcaggagagctcagtcttctgatctattcagaccttcagctgatgggatgaagcccatcatatgggatgaagctcccctatgttatggggagcaatctgctttactcgaagtccgcccatgtaaatgtcaatctcatccaaaaacaccttcacaaaatcatccaaactatggtttgaccaccaatctgtcaaaccgtggtccagccaagttgacacataaaattcaccaatacaggacccataccctcacgagggttcaagtctgttgcgggcctgggtgatacaaaagtacacaaatgaaacaagtgcagattgtggaaatggtatgaaggaaagcaagttgttaagagaggaaacagaggggaacctgttttagatcaagtggacagtggagggaaaaagcctcttggaggtgaagaagaggaaggagccagccctgacgagtgtagagtgaagagcattacaggcagaaggaatgacacagagtggcgagggctgccaggaactgggtgagcttgggaaatgccaggaggctaaagctggactgcagtaagcaatgggaagaggagcggcaggtgaagatagagaggcagccagtgccagatccttcagtgcctcgaagttaagatgaagccaaagcagacgaggaacaggatcagatttacctcttaagatgttctgtctggctgcagtgtggacatatggaacaggtgaagtgtggaagggggtgggcagggaggaactgaaatgctccaagcatctgaggggtgctcagaacaggatgtggcagcagagatggtgccatgcggcctgacctgtgtctattttggcaagagaaataatcaaactttctggcggattagctgtgtggctgctgggggcaacggatgacgctctcatttctggcttgaacaatttagaggaaacaagagcttttttccttgttaccagcctggctcgagttatactcaatagcggcctgcattatgcaaatcatgtgtcctaattaacgtagatccagtttgaattatgcaaatttttgctttgggctgtattagtcacaatccagctgatttcctcctgcctagactacctcctgcccatctggaacacatcccattctccacactgctcctctgtggaccagagtcatgagccagtctggggtcagtgagccctgagtggtcagtgcagcaaagctgagggatgggaggaggcatgctcatccatccagacagagccaggaaccttctctgggcctctgtcttaaagagtttcctcgtgagcttatccacccagctggtcccctctctccatcaatgtctgtgttcaggctttcgttctgttcagaactcctgtctcggaagacgctccagcctccttgtaatgcactctgatggcttgttgattcctggggcccgtgctttttgttcagattgaatccaaccatctgtgtgctgaaaaaaatattgacaaaccctctgacctattgtaccttttaaaggcgctcccatacaggaatgccgccttgttttattgaagcgaagtctgttttatttaactctgaatgccaggcacctagaatagcttgtgagataaatgccaatcaactctagcataatcaagacacccattcctgcctcattagggtcttctcattccctttaagcttctcagatttatacactgtaattagaaacttggtgattttgactgctaaacagaaaggcttactgggaggcttcatatgtctgaattttaaatattttcacacttcgttaacccagttgcaagtgtaacatcttctggcccaattccctcacactgtgtgatttttatttttggacgaagacgagaacaattaattgaattgaaacacatattgattactgttttccatgaactctgaacagcttgtctctgaatgattttattgaagggtttttagacaactgtttggttggattgcttcccttggtgacctcattctggctataagtgcctgtccgcaattgcgacggtctgtgttcttggtgagttgtggttgttcccaagagctgagtcagaatgagagaggccacaccacccttctgcacatccacaccctgattagggaaccctgatgccttaatcaaacccaaaagcagggttctggaagagtctatgcagatgtcatgatttccatattcctgatgtaaatattgtttagacgtcaggtgagcaggaatattccttactgcattaaatgatcacgttattcatgcaatgactgcaatgttttcatcaggcagagctttccagaccagttgatattcccttaccacctctaccaccctcttgtgctgatcacaattgtgagatttgagaatgtttcttaaaccagtgctttttatgctttaatgtacacatgaattatctggggatcttgttaagaagactgtgattcagtgggtccaggctggggcctgcgattctgcatctctaacatgcctgcaagtgatgttaatgatgctagtttgtggacacaaggccgttggtgctgcctctatctgtgcatgatctgtcactctgttaggggaatgatcatagaattgcattctgcatctcccactaaagtgcaaatccccaaagatctgaggccatggtctaattcatcttaatacttcctgttgcagctcagatgaggccggaaccagtgggctctgacgaggattctgagctcccctttcagtgggcagagagagagtttgaggctgctgcagaatgagacggtttcatagccctggagtggtaatagggtcagggtgagacacccatctttcagggaaggtgggcccaggatctaaaggtccatggctccagggtgctcatcaagataataactcattactaaaaagagggtgtcaaagctgggctagcagcagtaaagaggcagctgtaacaacactttcacatcttctgctcaggtataaggtcttttaataaatagttcatcttaatatcatagatgatggaaatgtccttgcctcctggtgcattttccagatgtttccaggatgcttgtgtgcccaccatctcttatccacacaacagctggatgaccttttaagaatataaattggatcccttcattcctctgtgtagaaccctcctagggctttccattcctttcaggataaaatgcaagttctaggagtcctgccatccctggccctacccaccctttcccccacacagtctcatcactgtcctctgtgctcaggaggccccagtcactccggtctcctttttactacatttttaagacttgcctaagtcatttccacctcagggcctttgcactcactgtttttattcatatgtcttcatcttcactactttaccttcagagactttggctggcttataggcaagaattaaacaactccaaaaagaggtagaatttttgatttcatgggtttgacatagatttactttccccttcattcttacccagttgaagccaagaacagtctgacaccttcatattagaaacagaggactgaagactggagacagaatgggacttaaagccactcacattttggggggcagaattgtctgaggatggactcagaggctgtgacttggacttgtgcagaaggaaatttaatctgaaccacttggacctgctgtatttaacaataacatagttatagtaatgaaacttccctccttcccctcccttattttttctttgcttgtaactttgctgaggccaaggttgtatatagaaggccacagacaatcctgaatttctcttccatttgcattatcctatttttctttgtaataaaatattctattttgaggccaaaagagggtaatttgtaatttatgaatttctctcttgaaattacaactagaacctaattttaaaaatcaaattggtttcatctaattaaatttgtaaattgcctcataaacacatgctttgttataaatgtttttaaaagcaaggtctcttgcttactgtctggggctggattgggttgagcccagagtaacagttacttctcatctctctactcaagagaacatactctcaattgccaaaagtttctcaagagtagtattttccagaacagtgcttctgaaaccgtaatacccataggaatcacccaaggatcttgttaaactggagaggcctgagctgctacatttctaactagctcccaggtcatgctaatgccgctggtctatggaccacgctaagttgcagaaaggggcaagacatctgtacctgcatttaggagtcctgggtttggcatctgggtaatatgaacttggtcttttcattttaaccctctgcactcaatttcctcatttttatgtaatgataacagctaacatttataatgttatttctaaatgccaaacactgtacaaaacctaatttaatcagatcttcagagtaatcctataaggccattttattattaccttgatttttctgataaaagacttaaggttctgagaggccacttgatgtactcaaggtcacagagcaagtaaatgtcagagctgggattcagatctaggctatataggctcaaatgtcaccatccttattttcttaggcctcactagcttttgatacacaagattacactcatgtttatgctcacaatacaatggcctaaatctacaacctccttagctgtctttacagcatccctcaataattttggcatattccgcaaaagtagcctcaaatgcttacaaacaactcaaccagttacaatactctggttccggttctctgcaaattatagcccaagtcacagcgaagaagctacctgaagatgtctttcatcatagttgtctcccatagaatccatgggaatgccaacatccctggcatctggtctctgaaaatccacaaggcatcagattcacacagaagtgagaaggacaacctgctctaatctgtacccacctttgtgcatggggcttcagagagtgcactatataataatgcctcaattgcaggaggttctactcaaacacagagtctaactcacagttgtgtttagacccttgctctccctctgtttctttcttcttgtcatggaattttaatcatgatatttctcatccagtctaatgcatcattctactagaggaaaaagtgtattactctcaaggatccaatctaatgcatcatcctactagaggaaaaagtatattactctcaaggaataatatgtgcagagatatgactccacctgcaacatagccctacagtagtagtttccaaatgcaggtatgtacaaggaccagggcttttccatgacaaagttgccatcaatccagtgcaaaattagaaaaaataatgtgactgtcatgagttagtaaaaaatcataaatttattcaatttgaaggatggacttttattctgaaattatatcctttctatatttttggaattatgtcttttataaaacgatgtaaataaaagatgttgaagtaccctaggttagtcccccaagcctttttaaatgctactggcctgtgaattccaaaagtcttgaacatctggcacacagcgtcttttacataacagtatcaagtaacttaacttcctaaatcatgggtcctttccttctgctttacaaagaaaagtttgccaggcacaacacatctttatttcatgtaaatgtgtgtgtgtgtgtgtgtgtgtgtgtgtgtgtgtgtgtgtgagagagagagagagattgtggtttctgctttacaaagaacatgtagatttgaagtgactggattttgtttcagttaaattttcgaacctctctttcccaaagaagttttgaaaatgtgctaggcaaggtgtattagtatgagtacctgccctcctctcggggtactccccaggaagaaagcttctcccaagcgtgtggcctgagaaaactcataagtgatggggatggatgtctgtttcctccttccatctggtaatcctgagagctgcgccaagctccctgcaacttctaagagggagatgttagctctcctgaggaatgctagttttagtgagataaggtgttttcttaagcaccttgtacatgttggataatcttctccctcagagagttctcaggaccacctgtgactctctagagaggttatcggtctgttagattaatcttgagtacttttccttcatcaaatactccttgactttcctccccagagctcacctttccttatggcagcaatattcttcccccaagcccactccctatacatgcatgtttctgcatgagctctcagtgacttaagcctcttcgtgggcctgtggtacatgtttcagtctgggatgcttgtgtctttccccctcgtcagattccctagagaaaccctgaagaagtgattaccacctttattttacaggtgagaaaaatgaggcttaaagagaggaggaatctaccaaaggtaactcaggaaaaggtggagctactaggacactaggctacatcattccagcttcggtatccatgcccttccctctgcattcctgtgtgtttccacttgatctagtattgtaatcttatgttgtgtaagaatacaaggggtgggaggagactcaaccttactcgtattgcaatacttgaatcttagctatatcagctctgttggagatttttttgttttgttttgcaataaactttcatacagtttgtcttatttttgcaacttttctggaaggcacattgtgttggcttgatgggtacattcctgcttgagtaggttctggttcatctctgatatggtaaggcccagctaatgcttggaatgggggctttggatgccatcacctgggtgacaaaatatgccttgggcacagagcaatttaaatctgaagaatcctgtgtccctggtgcagagaataacattgggattcttttcaaagcaaagagactgatattcgtaaagtgagcatcatgtgggtattgcagtttcccagacgaactttcagtactgtttgccaggcctgggccttctcttccacataagaacaatctgactccctgggttttggctcttttgtggatgaggtcagttgtcaccatagtcacttcaatgcatgatgtgtacaaatttctttgttcttggggctaccaggacagctccactgtgtgccattatgtttgcaccccattgtactgtcagaaaccttttggtatgtctcatcttactcacctttatacgttcagcagaatgggtattcaccaatgtcaggctgaagtgacttgaataaagctaagccaatggatgcagcacaagggacctccttacctcgtagagcgtgatgaccccattggtctcattgggaggtttccactggatgtagatcttctcctcaaagggccccccttggatggattctagaggaacagctcctggaactacagaatggaaaagttatgaacttgatgtcaccttccacatcatttctccagccccgctgacctagaacaggggttgacaaagttgctgtaaagaaccagatagtaaatattttaggtctgatgggctgtacgttctctgttacaactactcaactctgtcattttagcacaaaaatgactatagataatccataaatgaatgagtacggtggcgttccaataaaactttatttatgaaaacaggcaatgggctggatttgacccacaggccatagtttgctaacccattttcagaaggctgatcaggcttttcatctgcagactgagcaagtcggtttatgaactgaaccggataagggcagaaaggacatgagcagtttccagttctgccagaggtgggaatctgaaatgaggtgtttgcttcaggggtgtctaatcttttggcttccctgggccacattggaagaagaattattattgtaggccacacataaaatacactaacacgaacgatagttcatgagctaaaaaaaaaaaattacaaaaaaaaaatctcataacgttgtaagaaagtttatgaatttgtattgggccacattcaaagccatcctgggctgcatgcagcccaggggctgctggttggacaagcttgttttaggatttgtatttgagaaatgcaaagtgagcttcccatcatcttaccaagtatcattttcttcactctgccaagttttctctaactttaggagtgcttcatcagtttcttgactaattcctgaatccaacatgaactatgtggcttgaaaccccaatccaattagaagaagctcgccttgctccaagaaggcagctagcttgacttgttgttgagtcccaatgcctggcatgaagtagatgcataataactatttgttggttggatgaataggtgaatgaatgacctacgccagcattttgaactaataagtgcaacctttcctggggctccttctataagccggtcagtcttcctgccagcatcctcctgctggatttcactattcttacaacagtctggaagacggtgagccagaaaacaaattattccccaaactttctgctgtaaccccttagaaataatgaatttcagtaaattgttgccaaatctatttatattttggtattataaaagcacttactcttggactagaattttacctacattatttcacttaagccataaaacacctctgcccagtaggtattatctcctttgcgtcgataagagaactgaggctgagaaaatggaataacttgctgaaggtcatatggctcttaagttgtaaagagggaactaaacacctgtctgtgagttttaaagcatatactcttaatcatcacgctacgcctctctacatatagccttggccatatgttgcaatcagttcccctttgttaaattaaaatatgtttagttttgctcattatggacatgctatacagaatttgttgaatattaagaatatataaaaaggttaaaaaaggaaaagaacaaaattactcataattcacatgttcaaatattattttccaatctttttatgcatataaaattttattaaaaaaagatatgcctatgcatatatatattttttatttttaaaaaaatgttaactcctactgtgcatatttcattgtgaccttattttatcactaaagaaattgcaggcttctctggggccatacatttctctggggccatgcattttaatggctgcttagagggggcgttgcccctttatagtcactaatcctttattattgggcattaaagttggtttgaattcttcatgattttgagcaatgctggaatgagcatgcttataggtaagtatgcatgcaactctgcagatagaccttaagattaatgctttggaaattaatttactgggccaaagtaaatgaactattttatttttaaggcttttgacatatattaccagattgcctttcagaaagtttgtaccattctggactccccaacagaagactatgtctgttcttgccaacactgactatttaaaaaattaagtgcatgtgtatgtgtgtcttttttagaatactggagagtacagattttgttttcagcctaattagccattcacattgcttcttttatgaacaaattatctataccttgtgctcattttcctgtatggctcttcatttttgctcatctttgtcttatgggctcgtcattgtaatttcattttaaggacgtaagctttcttgcataggttgcaaatatattttcgccagtttttttgttggcttttgaaatcacttaggtatgcagaagcttttaattagtcaggtatcctattgctttcccttatccacccttcctttccagaaatatttattatgtatttaatatgatgaagggacagcgatggacactagagatataccaataacaaagagagatgtagtcaaatccatggtaaagcttgtattctggaaagagagacagacattaagcgattatactcaaaactaattcattacatttttttaatcaggactctgacataaagggatatggtactaggagaattattaaaagcagagaacaacctagaatggcaagttaggatattaaatggcacataagttagagttgcttgataagtagaagttatcagggcaaaatggggaggaggtgctgtagtgtggtggacagctttgtgaggttgagggtggaaggagaaaaatcagttaggaggctgtcattgtcatcctcgggagaaagaattgtaacgtggactggaatgatggtagtgtagaagtgaaatagattgtacagatgtggactcagaggatggcaacatggaagatcaatgacttggtggtgatagataagggtgaaggagggaagggatgtgtcatggagaactgcaacccttttgttttacacaactgggggatcaaaatgttgtttatagagagggagccttaaaggatgaccaattttggagaggaagctggtgagctcagtttttgtcatactttatttcaggtatacatagaacatccaagtggcaatgctgagtagcagttggatatgggaagactggggccaatgtttggaaatggaaaccgtaggcagggaatagatggcaagagtatagagcagagaaaaaaaaataggtctaagactaagtgaagaagaactccagaattaacaattaggaggaaaatgaatggagaaactgggagtcagtgttcagagaggcaaccagaaaaccaggaaggtaagccgtcattgtagcatccaaagaaggaaagaggctcaagaaggtactggtcagcagtcacaaatatggctgagtagtcgagtaagatgtggctttaaacttgcccattgaacctactgtcctcaaggtgactcgtgagccaagcaagagtaatttaagggagaatgttggcatcacaagccatcctgaagagggttgagaagagaggggaaggtgaggtgaggcaagtaaacaatgctggctgtgaaaaggaggggaattcaaaccataacaagaatgagatatggagccaaaataatgactctcttaaagacaagagaggttatgattaaagcaactaagaaaaagattcaaaatagaggctgggcttggtggcccacgcctataatcccagcactttgagaggccaaggcgggcagatcacgagatcaagagattgagaccatcctggccaacatggtgaaaccctgtctttactaaaaatacaaaaattagctgggtatggtggcgcgcacctgtagttccagctactcgagaggctgaggcaggagaattgcttgaacccaggaggtggaggttgcagtgagccgagaccatgccactgcaccccagcctagtgacagactgagactccatctcaaaaaaaaaaaaaattcagaatagaggtaagaagaagagtgagaaagaaagaggagataacttacaatggtagggtcctgaaagcaagagcaagggtgggttgaaagaagggttctctccttttgtgagagaagaggagaggatggaaatgtgctaatgctttgtacggaggaattgaagtgtcctaatggctctgttttcttgagaagtggggtgaagccatctaccaaaagtgtagtgggggacgaattacatcaagaatttggaaagacaggagaagctttaatcacagagtagaaggcaagcagaatagagagatgaaaattctattcattcatttgagggtctatctgacggaaattgaggagggtgtgtctgatggacaataagaagtgtctgtctgatgaagactgtgagcatgaaactcaagctaatagatcttggtctttccaatctggggaaaattctctttctcacaccagatcagatgaatggaaagtacagatgaatagttgttctataatttatttattttctgttttattcccatctttttctttttacaccttacacgttaatatttctgaaattactgtgtataccatacatggtagaaatctataattccttacaattttctcaattgtaaaggacaattaattgaccagtcaaaacttgccccagtgatttcaaatgccatcttactaccatattaaattattttatattctagtgtatgttgtttggctttctgttctatttcactaagttgtagcttttactgtgacagtatttctctatcgcattaaaatgacatgttttgatacttggtagaacaagtcttattcttcttttgcaaagctttttgaggtatcactacccatgtattcttccagaagaatttaggaagagttttataaaatttcaaacatatttcatcacaatttttactgcagttgcattttttttctcttttttgggaagcagagagtatcacttttaaagtgagtccttttatccagtaaactgtataaatcttcatgtattaatgcttctttttatgcccctcagttaaaaatgtttttcttttatttcttacaaattgcatttctaggactttattattgttcatattgtttttgtattgtattaaaaagtttcttttatagtgttttgcaatatattaaaaagtatacataataatgtatgaatagttcaaagaataattattaaatacacatgtgcccactatctgctctaagaaataaaacattactatactattgaagcactgtttatgcccatcactattgtctcctttttctttctccatcgttaaataaataaataaataaaataggtactacaggtactatcctgattttccttttttttctttttcttttctttttttttttttaagacagagtttcactcttgtcacccagactggagggcaacagcgtgatcttggctcaatgcaacctccgcctcctaggttcaagtgattctcctgtctcagcctcccaagtagctgggattacaggcacccatgaccacgcccggctaatttttttttttttttgagacccggctaatttttgtattttcagaagagatggggtttcactatgttggccaggctggtcttgaactcttgacctcaggtgatacacctgtgttggcctcctaaagtgctgggattataggtgtgagccactgcgctcagcctgaatttactcttaatcattctcttcatttttattcggagttctaaatatatacatatatcccaagacaatatatcatttagtttttcttggtttcttttaaatctatgtggattgagtgttttctattatatgatttgcgtttgtcactcatcattttcagattcatctattttgatgcacatagttgtatctaattcatccccatcttataaatatattcctatttattccaccattctaccgtatatgaacagtagagttgtatccaggtagggtttcttacaatataatttattggaatacttttgtatatttgattgaacatatatataagattttactaaggtacacttaggaagagagggtctattcctatgactgaagggcttatctatctttgtttttacagtgtaatgccaaattgttttccaaagtggtggcagcactgccccaagcaatgttctgaaagttcctactcctccgcatctttataaatatttggtattatcaggttttaaaattctagaccatctagtaagtgtaaaacaatacttcattaaggttttacatgcttttacctatttactagcatcttttaatgtttgttggatattattgtccttttcctgttgcatatgtttgatactaatcattttattggctatatgtgctactgaaaaacttcttttaatttgtgtcttgtgtttctctttatgttacctttgaatatggatcagttcttaattttaatgtactcaaattgatcagattttagtttttgtatgggagaaagagagagacaaatttagtagcagacactgttgatggcctgcctatatcccactgaataatgcttactgcaaagtacaaatttacctaaatgctgtgggagccaacttgttctccacgtagaagaagcaagaagtgccagagagttaatgccccgaagacatccttcaagcaatgaaagacaggaagttgatggatgaacatcccagtttccttactacttggttgggttactctgagacatgttttactagcacttctcaaactatttcaaacactgaaaccattgtgatgatgataatgataattccaaatccattgtggactcatgatatcataaaatacaataaaaatgaattaatagggaagtataatttttaagtaaaagtgaaattgaaaaagcaaaaaagaaaaatactaagctccttctttttaaatactttctctttctgtacttgtcttgttatggattagagagtcaatgagtcagtgctggtccttggaccacactgggaatagcactgttctagaactcagttattcacatggtaattttttgttaataaactttgtattgactttcttccctttcctgtttcactttccctctttcttatgagtgtgtcctgagaccatctcctaaataaactacttccatttgtatccttatctcagggtctgcttctgaataaacccacacaaaagagtttttcttacataagaaacactttctctatcctgaagtcatgagaatatttgtctaaattttcattgacatttaagagttactcttttaataaaatgtcctcaattcatttacaactgtgttactatgtataacatgaggtaggaatccaattttaattatttctcctcatcctagggagattgaaaaaatacttttaattcctcagttgatttgcctgataattttaacttctgtcacatttccacatatgtatgggtctacttctatgttctattatattcaattgtttctgttagactttccctgtgtcaataccacatcttaattaacaatgaggtgtaagtcttgctatctggtaaagtctactactttgtacttcatgttcatgactgtcttgggtactcttaccttttctctttacataaacatttgaggactagcttgtaccttttcaaaaaatgtttggtttttgaattttagttgcatgtattatagatcaaatgggagataatatcatgtctttataataatagttttctcatccatgaacatggtatatcttttatttaggccttccttaacgtctttcagtgttttatagatttatacgtacatcttgaaaacttatgttaaatgtattactaaataccttatatttttattgctattgtacataatgtctttaagaaaataccacatacttgttaggttaatagaaatggaattgactttttaatgttaatgtcttggcaaacatgctatattcttatattaattctaataatttgtttgcagatttctttgggttatctatgtagagataattgtagcatctgtagttaataatagttttgctcttttccaatcttttattttcttatcttcaatgatagccaccaatacagtctttaatagaaatgatgatatgtctatctccaatttcaaagataatgatgatattgtttcatctttgagtatgatgtttgtaggttttttagttatctttatcaggttgagggggcccatttttattccaggcatacaagaatattttgttttttaaatcatgctgagaattaactgatgctttttctgtatctactgtagtgatgatatgtatttcccctctcctagtatgttactgtagcaaattacacaaacagatttactaaagttagactaacactaattttttaaactatttttttgcatatttatgcagtttcagatcatttgctaatattttgtttaggtatttgcatacatttttttctcataagcttttctgcttttaatatcaaggttatagtcttgtcataaattgaagggggaagtgcttcttctttttcctttctcataaagtgtgtaagattaggattacaaactccttgagtgtttgactgattgcacttgtgaagtcacctgggactgatgtgtactttgttgcaaaagtttaaattactgattctatttctttatttgttgtaaaactatacagaattgcttttccttaagtcaagttttttaattaatagtttgccatatcacctaaattttacatttattggtataagattatatacactatcatcatttatcttggttactgtgaaataaacacaaaagcataaaacaatcatctcattaatttttcagtactgaacttcatactgtgaccttgcttttccttatacttttcactccttaagcacatatccctaaatacaatagagtttatcatcaaataaataagaataataaatagtgctaaactcttttacaaaggccagtctgggagaactaatacctttacaatcttaacttccattccatgaatatgttctatcccaggatttatttagatattcttactgagcatgcgtattagtttttttgttttgtttttaaaaatcttgtttcttgcttcaattgttagggggtatttactttgcactatcagatttgttctttacaataagaatgaaagcatttttaaaaatctgtccagtaacctttccgcatgcaacctcataagaagtggtgtgtgatggtctggtttaatgggtcattctgctagttaccatgtaagtccttattttaaatatttccaactcacagggaaaggaaagaatttagatatattcatacattacttggctggataagagttctgtctgacctgtggggcagtggtatgaggggcagttaaggaagggaaataattaggcagcaggaagattctccgtggcaagagggctttttaggtgttttgaggggcagcctgaagttagttaccacagacactaccccttcctgtaattgtttctttacaatgagatccttccactgaagccccttttcttgtttgccatatgccctggacgtaggcttggagggggagctctcgttctctgcatcatggactagcaaataaagatgaccagggcactgacctctctcctttccccactcccatccaccagctccaacgcccactcctgtttttagcactggttggtcaaagttggaggtacttatgcatgtagacttggaagtcttctcctccaattccctaaggggttttctttccaggcagtctcagcctagtcatctctttcccatttgggactccctctcccatgacgtcttgcattaattctttcaggagcagccatggcatcgttttacagttgtcagtgcagatacaaaggtgtttttctctatatttctttaggacagtagtttaagaagagtgatcaaattggcatttctaatcaaaagtcttattgtcatcactgagacctaaaaggcagtattgtagaattaaacaatgatcaagggttgaagccacactgcctgggtttatgtcctgttcccaccactgtattaccttggccaagctgcttaatgtctctgtgtctcattttccttactttaaaatgaggataaaaatactacctactacataggttgtcctggggatttgatatgttaatatacacaaagtgcttacctaggtgtctggcacaaagtaaatactatgtttgtctgatcctccccctggccccattgcattcactctgagaacagctctagggtagcctagagatcactaatttgatttttttgtagagacaattaagattgttgctatttcctgtgatgtccttacctcaatctgctctatccgaatgatgttatattgctaatcatagaagctatatcttctcatagcttactgagctttctacgatcttcttctgatttctatggtaaatgatcttaaatctaatttttctctgaggactcagaattcattcgttcaataatgtatttattgtgtccttatttgtctacctggcactgttcttctaagtgcttgggaagcagagtaagaaaaacacaaggaaaaaatcttgtctctgtggaatgcattctagtgggagaagacagataataaaacatatagtgaaatatacagtatgtcagatgataattgctaaggagacacccaaagctggaaagagagacaaagagtgtgctgtaggagacttccagtttttaatagaatggtctgagaagagcttgctgagaggtgacattggaaaaaagacttgaagaagctgaaggaaccatcctgcttatttggcagaaccttactgtagccaaaaaggatggcaagtgcaaaggccctgaggcagggatgtccctgatatatgtgaagagaatgataactgaatttgcatagtgaggcacaagtagcaagagatgacacagaggcaaacaaaagtgggaattctggtcacctggagcatgtgagctaccgtgaaacttcgggtttttaatgtgagtgacaagagaaaccatcagagggttgggagcagagggagtgatatgatttgcttcatgatttaacaagatcattttggtgctgtgttgagaaaagaatgcagcggccagagctgaagctgcaaagattatttagaggctgctgcaataatctggggtgcagagcacagtggtttggacctaaggggtagtagtagaggctgtgagaaatggtcaaggtcttgacatacattgcaggatgaaccaagagaatatgttattggttcagatgtggggaacagcaagactgctgctttgtacaaagccagggggtctcaatcaaaagcaataaagggtgaagaggttctctttttctttttttgagacagggtcttgctctgtcacccagcctggagtgcagtggtacaatcatggctcactgcagccttgacctcccagcctcaagcagtcctcccacttcagcctcctgagtagctgagatcataggtacacaccaccacacccagcaattcacctgccttggcctctcaaagtgctgggattacaggggtgagccaccatccccagccagaagggattttctttggagatgtaaaagccagggcctcagttctgacaaaagtgagaagtcaaggtttttggctcgagacactaataaaacagagttgccatttactgagatggagaagacagtgggaagaacaagttgaaggaggatcacaggctcagttttgaatgtgtttaattccacgggctgattagcaatctaggtggagaggttgaggagacagctggataaatgactccggagggctgggcagaggcctggcctggaggtatcaattgggaaaattattaacatatggatggattttaaagccgggagactagaagaaataattagggaaatgaatgtggatccagggtcagcaaactatggctcttgggttgaatccaaccagctgcctgtttttgtaaataaaattatattggaacactgccgcacccatttgtttatccattgtccctggctgttttcctgctacaatggtggcatcgagtagctgctacagaccctctcatggataaagcctatactttaagacctggccaacctctggtatggatacgaatgggaaagagtcccaagaactgggccaataaggttgggatgtgatatggtttggctgtgaccccacccaaaatctcatcttgaattgtaatccccataatctctacatgtcaagggagacaccaggtggaggtaattaattcatgggggccatttctcctatgccattttcatgatagtgagtgagttctcaggagatctgatgttattataagtgtttggtagtttctccaacgttcattctcctttttgccgccttgtgaagaaagtgccttgcttccccttcaccttctgccacgattgtaaattttctgaggcctcccagccatgctgatttatgagtcaattaaagctctttcctttataaattacacagttttaaccagttctttatagcagtatgaaaatggactaatacacgctgtttaaaaggaaccagcaaactgtaatcccaacattttgagaggctgaggtgggaggacggcttgaggctgggagtctgagatcaccttgggtaacacaatgagactctgtctctacaaaaaaagtaaaaataaaaataaataggccgggcatggtggctcatgcctataatcccagcactttgggaggccgaggccagtggatcacctgaggttgggagttcgataccagcctgaccaacacggagaaaccctgtccctactaaaaatacaaatttagccgggtgtggtggcacatgcctgcaatcccagctactcaggaggctgaagcaggagaatggcttgaacctgggaggcggaggttgcggtgagccaagatcgtgccattgcactccagcctgggcaacaagagtgaaactccgtctcaaaaataaataaataaataaaataaaataaataaaacaaataaattagctgagcacacttgcacatgcctatatgtgcctatcccacatgtcctagctactggagagggtgaggtgggagggccgtttgagcccaggagtcagaggatacagtgagctgatcatatcactgccctccagcctgggagacacagtgaaaccctatctttaaaacaaaaacaaagaggagaagccactgcagaaggagaaaatctagaagtgtgtgatgaattggaagcaaagtacaaaaagtgttttaaggaggatttaacaaccagctgtgtcagatattgccaactggttaagtaagaggatctgactttctgagtaatgactattggatttggtgacttgaaggtcataggtgatcttgaaataattgttttggtgcaatggcagggatctgagttactttggttgaatggattcaagaacaaatagaaagaatggatgcataaggaggggatggaatagcttgaggagaagatagagctgggtgtttctgggttttttttttaatctttttaaagatgggagaaatacagcttgtgtggagggtgagaaatatatccagttacaaagggaaattttgatgtagggtggaaaggggacaattgctggagcaatgacattgagttaaaaaaaaaaaagtaagtgggatttgctgcattaagtagcaaaactggcctttatttaaaaagcaaatggttcatccatagaaacaaggaggtgagggggaggtcaaatatgtgggcaacatgtgggcaatgagagctggagggaatttctttgaatggtttcagttcctcagtctattaggtaacaaggtcatctgtggaagtgagaacaggtggatgtgctgttagtctgaagataggagaaatattctctgggagactagagggatgaatgggccagggaaagacagtattgccaggcagctttaaaagccagctccagtggtgcttctggcttccaagtgagagtggttagcgcagtggtgtgcagcagctacggaaggaaagacctagcacaggcaggaaatcagatggagctagggttgtgaatagctggaaatgagaatgaggctgaggtgttgggggattatgcaaggatgtaactggaatgatcagtcaaggaatttaagctgggtagagaagggaatgagggcaatgaacaaggtagcaagtcctagtggggctgaatttttggagctacaatactagagggaataaattgaaaagagaagagatgtggtcagagtgaaatgtttaaaatgagattacagaggggttagaggttatttaaaagtggccttttgcccagggcaaacggaaattttggatagagctcttgttttgttttttcctgaacaccctgaaataaaaagctctctatgatgtctgatgttggccacacactacttagcaaagctcttggcagacagtaagttaagggctttacacagactttcatgtgctacagcctctgtagcgagccattttacagatggggcactgaagtgtacagaatgcgagtccttaaaccaaggttgcatagtgaagtagtggatgaagcctggatatagctcaaactcttctatttccaaggcatttcccaaatcacccctttcttctatcacctggtaggtctgtgggtccagaaggctaaaaggctgtcatcgcatctttaagcagcaaaatcaggatgtctcaccccaagtaagaggctctttccacccaccacattaccattccatagtcaagatgtcctttgcaaggagatagacttactttcctttgattaaactaggtctctctctctctctcattgtaaaaagacttctcggcaaaaaattcctttttttgtcttatcttctaattctgtatcccttttccattcctttttctttgtaattctttaatgaatccacattttccctttccacaatttcatttcttcttctatttaacagcatggaactttccatccttttgacagagttctacaacaaaggttaattactttataatttcattctcttaaaaaaaagcacactaaaattgctaattttaactgtgcttcttgtcagtgggttcatgtaaattcactgtaattaaaccagatgttttcttgtgccttaaagtcaggtggtaatttaaggaagattttcatttcaacataaaggaggacagagtgttatcaagggaagttttctcctctcctctcccctttcctcccctcccctcctctcctctctttatctccatttctacatctgaaaaggggttaacaatggtgaactttgggggtagatatgaggaataccaaggtagtatatataaaagcagatagccatgtacaattcaacaggagtttcccttgatacttgtctatgtcatttttttgtctctccacttcagttgccatatttctttattcattcattatacagaggcttggaactaacttaataagagagatttagataattttagtctcatatttcctagtcgtgttggagaaaatacatttgttccagataaatctttacatcttaattaactatagccttttaattgaactatacagttgtatgctactaaatgtttcacaacctgctctccagggaaaaataaaaacaaaaactttgccaacttccatggtgtaaatatttccaccatggtttatttgaagcaacgaatgtggtactactgaacttggaggtgggaagagatgcaagcaagtctgagttagctttgaatatagctaaaagacgtcatacatatcccccatcttcacaaacaatacccataaatgggacactatggtatcacgaaaagggcatgaacttttatgtggaatggtcatttattcatccatctattcattcaacaacgagcccatactatggattaccagagtgaacaacacaaaacaaagtttctattcccattaagcttatatccctcaaagagagataataaagtaatcaatatacagcatgaggtagagaaaaataaaacagagaacagcggtagaggttttggccaggtatagaattatatattgggtggtcagggaatgcccttcaggtaagattttgaattctatttactcctcttctgcacaactgtatcgatagcatctacatcaaagtatttgggaattgactgtaagaatggagagtatcagcacaatgcctagttcatagtgtgcacttgaaaaacataattgcatttctctttgccctttataatatctcaagaccatcttggtaaacatctcaaatgtactgagctctaatacagtgatgccttcaggactcactaaggtgtgaatagctttcactcttacactaaatgactctggactgctttacttattgccttgttgttattgctttttctgctttttctctcacttttcccttttcccggttttacatgccacatcttgttactacagatgtactcatccttagcaacatgcagcctccttctagcttactgtgacctgagaaacctgatcattggctcattagaaatgtacacttaataaaggtactcattcctgaggcatgtcagtcttccttacaattcaagtacatgagttttttaaaaagtatgatgctaaatgaaataatatatgttttgtatgtgattaactgtattaaatatcaataatattatggtatatattaagttattaattataatcaattacattatatgtaattattatatgggattctacatttccttatttgtaaaatagaaaaaaaaacactctttgctccttcacatttagtgttcagattaaatgaatctacactgctagtgaaaacacaaaatcatacaacttctatggaagagtacctctcaacagctaacaaaacttcatatgtacttactctgtgactcttgcaatcccacttttaagaatttaccctaaagatacattgccacaagtaccaaacaacatatgcacaatgctatttgctacagtattatttatgatagtaaataacggaaacaacctgggtgtccactggatattggttgaataaattacagtatttccatcaacacaatgaaataccatagtgtcataaaaaataaagagcaaattctgtagtaactgatatgaagtgatttctaggatatactgagtgaacaaaaacacaagatgcaaagtatatcaattatgctaccttttatataagaagtaggaagaagaaaagtattacatatttttttgcaaaaagaactctaagaaagatcaaccagaaaggaatgaaaatagctacctttcaagtgtggattggaatagtgaaaagagacaggaatggcggtaatattttttggaatatacgttttaatgtagttttttaatggtgtttttatttctaatttaatttaaagttctgagatacatgagcaggaactgcaggtttgttacataggtaaatgcatgccatggtagtttgctggacctatcaacccatcacctaggtattaagccccatatgcattaactatttatcctgatgctctccctccccacactcccccaacaggccccagggtgtgctgttcccctccctgtgtccatgtgttctcattgttcagctcccacttacaagtgagaacgtgcagtgtttggttgtctgttcctgtgttagtctgctgaggataatgacttccagctccatccatgttcctgcaaaggacatgatctcattcctttttatggctgcaaataccacattttctttatccagtctatcattgatggccatttgggttgactccatgtctttgctattgtgaacagtgctgcaatgaacatatacatgcatgtatctttataatagaatgatttatattctgttgggtatatacccagtaatgagacacagtttttacttttgaaacatgcaactgttttgcatattaaaaacaattaaattgaattaaaaagcataggtggaaggcaaacctttaaatggaaacaaatgaacataactgggtatcaaattgataatataaccatacagagaaaagaactgaacttttgaacatagtattctcactgcataccctcagtggtatacagcctaaggagataaaaactgaaatctttaacctaacttagtataatagctttattgttttttagagggattggtgttgtaattctgaaactattttatgtgtgtttcaggaaatgaaaactatgtggatgttgagcaccagggttctcactgcaggagaaggaagatatatgtataaaatgtgttgaatttgaatcagtatgagctcatgacttaaaacaaaaataaattatactccctagctctacctactgaaagaacctacaggcaataacgcatcaccgagcacacctaagatgtatatcttagtgccaaaataccactccccattgaaagcaaccacaaatccctaataagtggttggcctcaggtctggggcagggacattaaaagaatagtctagaatatttttgttgtgccagaagcaaggaagactaatgagaacatgtcaaaaggacctgggaatcagcttgaagagactgccactggccatatttgaggcaatttgagcatcacagagaatggcagtagaggatttcaatacacggagtcaaaaatgatctatgaatcaacagggagaccaaaaacagggaggaagatgaagagagaaacaactcttctctaaagaagaaggctaactagtaagcgtagggagaattatagatgtttaaatcacccttttgtaagcaccaacgtaataactggttcaggtgaagactctcaggacgtgttaaaaccattgagtgaaagctttaggggaatacaatactcattccatctcaaagtttcactccaaggatactttacaaaagaaaaaaggtgccacatttacagtggagggaccgggcagttcttgtcttatctaagtgaccatatgtgacatcatcagtactgggactccctgacattatgaacttcttgacaaaatacaatgagaaatatacatcgccaacataatggttttgccaaagatatacggaaccctggttctgtcacatagaatcaggttaaatattattagaaatgtaaacaaactgtatattacatgattttaaaattaatgcaaaatttattagaggttaaatagcattgtgggtatgtagcataaagttcttatttttaggtcttgtatgctaattggtttagaaatcaactgtcatgatttctgcactttactttcaaatggttaaaatattgtatgtattcataaatatatttacatagcatatgtcacctatcatgtagatataagatacacacacatgagtaaatgcagcaaagtgtttacaaatgttgaatctagatgagaggtttataagtctcctttgtactattctttcgatttttctagctttgaaaattttcacaataaaatcttgggctaaaggagtacaggagccactgtatataatatgtctatccgtgcctagcacagtgtaggtgctcaataaatagcagtcaaagtgagctgccaagcaaaaccatcaacatggttttcatctttcaaggtgcaagcgaactgtggttttgtctgagacatttgtggaaaagggaaaaataaagaatctgtttagtttcttatgaacagctgctacccaaatgaagccatggggctcagcagccatgagctgctctctagtgctggatttcttcgcaggccgtcaaatgcactgaggtgctgaaattacaaattctgcaaattccccagaagacaattttgtggcacggatgacagcagcatgaattcagccattcagccaactcaatcctaaaggttgcttgctggctcccggaggggggtttcagttaatctactagagccacgctctagcctcatcttgtccttgaggtgaacgagttacccagccaacagaagtggtgcttcctctctctttagaaagaatggaacttaaccctggcatacagcagggtcctacactgagactctccttcagtccagtgggttttgaggcagagcctcagaatacagaactgaggaatcatgtctcgtatgttggtgtttttagtaatgataatgtccacacatctccatagagcaggaattgatgctttattaatgatgtttaattaaaatttaatttcaaagcattcctgctctcatgttgttttgataaaggcttttttttcttggtgacaggaagaagaaagagagaagttaaggaacgccttaaagctggacttggggtttgctgaggcacagggaggtaatcctcaaagagcagctcaaggtgggcaaagaatctttaaaaaggtgccctgagctgctccttgggaaaaccttattgttcatctcctgagtcctgaattttcatgctgattttcagcagtgacttctccctctctaacaaccaggaattccctgtgaatatgagtcactaaaccatccttttgccctgactctgtttctcatatcaggcaccaagcacactgccactttttgagcatctacagtgtatttcccacaaccagttagatttctagatgtctggacatgtctacagctctgaagaggtttcctaggggagctgggaagtttctcaactgccggggatagatgctcctttgtgaatacctttttgttttttttttctcctgtgattcaccacaaatatagtaccttataacatgctgggtattagtccaatttctttatataccatgccacttaatgtgcacgagaatctataagataagtactttaattattccttttttgtttgagacagagtctcgctctgtcacccaggctggagtgcagtggcgcgatctcggctcactgcaacctccgcctcccaggttcaagcgattctcctgcctcagccttctgagtagctgggactacaggcatgtgccaccatgcccagctaattttttgtatttttagtagagatggggtttcaccacagtagccgggatggtctcaatctcctgacctcatgatctgccctcctcagcctcccagagtgctgggattacagggtgagccaccatgtctggccaattaattccattttacagatgaggaaacaaaggcactaagaggttaaacaacttgtccaggcatgcttggctccagagtgtacattgtctgacagcgcacaattctacctgctggaggaaggggctacagatttctgaaacaatgaagtcagatctagggaaatcttcctagaactggaagttttacagagtctactccaaggatgaccccaaagaccagtgtgtggggtctgcaaagaggatggctacgaggatgaactggaagggtgtaagggagggatggatcatcaaagtagactgtgtaaaacttccagatctaggatgggacatggtggaagtgagaattaggggcagggtgagaagaggctggcactatttcccttgtcttctcatgagattttgcagctgagaatgtgaatctgggttctactcagggtcataactctgaagtatttagaactcgcttagatgaaacaagagtactagatcctactgaatcccaggaacacacaaagaaagaagaaaatgaaaatgaaaaaaagaaaacatgtcctaaacagaattgccacagtagaggctctgtcttcaagttctaaggctaatctgagtcaagccgggtattttctttatgcagctgacaatgccagtgctctggctagacctttcagacctctttatacaatttttgtgagactctatcctttacctgcacatgcagagagacaaaagttactgaaattttacctctgaatctctcctccccatcccagaccctaactgttggctggcagcttccttgcctaacttaggacatctgtgatgcatggcccaccctgaacagttccctgaaggctcaggttgcagccagtttttgctggacttggccaaaagttgcaccttggctttctccccttccttgtcccacttccctcactcccctcccagtctcccctgggaaaactttcttaatcagtcacatgcacacgaatcttcatctgagtctgattctcaggaactatctaaagccatcccacaaggcaagaggcagcctgggctggctggaggggaaactgaaatatggtcatggggaagtgtttcttaggtaagccctggaactggcgaattctatgctatcactaaggtaactgcggtgagcctgggaagaaacatccaagtcaatctggggcaatcaaggaaagcttcctggaggaagtaacatttgagcaaagacttgaaaggtcaatagaggtttccttgcaaacatggaggacaggtcattccaagcaggagaaatggcatgggtaaggacagagaggcaggaaaagttatgtgttctagcagtagtggctctaggttcttggagtctcaagttatgaggaagataaactgcaggaagcatacccattagaaatgggggtatggaggtggggtgggtttgggagggagacatggaggctcctaggctggctttcaggtctctatcttgagttactaggtgcagttcattgagataaggaatacaggaaagtcagtatagaattggagattagttcaatttcagataccttgagcttgagatgactgtcatccagccagatgaatattcagttctgggtggatccaatgtgtacgctaagctttttatatctattttctgtttttaattcttacataattcagcattgtctgacttccaaattcaacatgtttaaacaatgtgatacatgttttatctttctggaggcatcagtgcagtcaaaccttggacagagaaggtggttgatatagtttgggtatttgtcccctcccaaatctcatgttgaactgtaatcttcagtgctggaggtgtgattggatcatggaagtggatccctcatgggttggtgctgtcttcgcgacagtgagtgaattccccggagatctggttaagtgtgtggcaccgccaatcttttgcgcctgctttggccacgtagtgttcctgctcctacttcatcttccaccatgagtaaaagctcctcagcctccccagaagccaagctatgtcagtgctatgctttctgtacagctgcagaactgtgagccaattaaacctcctttctttataaattacccagtctttataaattacccagtctccggtgttttttttgttttgttttgtttttttggtagagatggaatctcactctgttgcccaggctggagtgcaatggtgcgatctcggctcactgcaacctctgcctcccaagttcaagcaattctccagcctcagcctcctgagtagctgggactacaggcacacgctgccacgcctggtaatttcttttgtattttagtagagacagggtttcaccatgttgcccaggctggtctcaaactcctgagataggcaatccacctgcctcagcctcccaaagtgctaggattacaggcatgagtcaccacacctggccacaggtatttctttatagcaatgcaagaatggtctaatacactggtataaagcaagaagagggatgggggtacaaaagggccaaagctgagtgcaagtctatggcagaactgtcactgtgatgggaaagcactccctggagttgtgcaatgcacagtttacatagtccttcattgaaggcctaagaaaagaaaggtgtgtgtgagggaattaaaaatgtaggaaaaataaaagcctcataactgactgccatggccctgtgaatagattcaatatccccattcccatgtaagctctcctcccttgctcaccgtcttcctcagtctgcaccaccagctcctcgctctccattcggccctcggggttagacagcaagagtcgcagccggatggtcatgaaggggcgcaggcctcgcagggtgtagtgggaggaggtctggatgacctcctcggcctcgtactgctgctggttgaacacatactggtactgcacggtgaggttgtagctatggcagcgggtcaccgcgtagccgaagggctcccactgcagggtcagctgccgggctctgatgtctacgatttccacgttctgtgggccatgtaccggatctgcaaaacatgcaggcaagaaacaagggttctgaagagaccatcgggaagctggggtacatgttctgctacaacagggaacacagcttttccaaacatatctccaccattcaatcactgccatcatgatttttgacacaggcaatataatttagagaacatttttctttacatcaatctcccttgtcttatttaaatacatgcatctaatagaaaacataaatatataaaaggaaaacatcttaaataaatgttaaccataaaaataaatgtgaaattgttaaattcttaagggtgcatcaaagtgccactgaaaaccttcttggtaccacacacagcacactcctcgcttctgggatacgcttatttagacggctgctgagagctgacctgcctccttatactgaattcagccccagcctgtccccttggaggtcagcctctcctcttcagccaacaacatccagatgcactagctggaaactgagtcacagcctcaacccgcaacacccagtttatccatgcgttcatcatgacccattaaccctgctttaggatttcctctcctttccttgactacacagttcatcatttcctaacctcctacaacagtcttccatccctctttttctcccctggtccctctgggaacatcattctaaaagctaatctgagcatgccttctcaccctaatgctgtctcccactccatgcctcctattgatcttggtcccagatcaccatacataatgttgtctatgtctaattttattaggaatattctatttatactttatgcacattaaatagatttttttaatataaaacaggttataataaacatgatgtttttcaaaaatcctcacatgtaaagctcattttatgttgaggtttaggcatttgtctttggggtggcttgttttgtttctttgagatgggagtctgactctctatcctaggctggtgtacagtggcacaatcagagttcatcccagcctcaaactcctaggctcaagcaatcatgatcctctagcctcagcctcacatgtaggtgggcctacaccatgcttggctaattttttatttttattttttcacatatggggtctctctatgttgcccaggctggtctcaaactcctgggctcaagtgatcctcctgccttggcttcccaaagtgatgggattgcaggcaccatccaccatgcctggctcttgggtcaggcatttgttatgttagaaacataacttctcatgtgatagatacacccagaaattcttgtgtcagactttcttatctgggaggagtcaggcacaggctggagattaaatcagtacttctccccatacctacagaactttgcccaattatgtatcctctttggatccactttttaattcatttgtaaaatgatgataataatagtagctaacctcatggcagggggaagaggaagttagatgagatgcttgtaaagcagttagaactcaaacttaataagcactctacgtatgataactggggtgtgttgtttgttttgcagtaatagtaataatatatatgtaatagtaataataatagtgttccgcatgctgtgtctaccttgaatgccttgtgagtggcagtgctgggagcacccttatgcaaaatgatggactaggtttccatcattgctccaatcccctcagagcatttaagggtaaggctacctctgcaccaatgcagcaataagaaagaggggatgctattggtgctagttgatctgtccctatggggaaaatatcctgtaacttgtgtcggcgtcctaccaaggaacatagttcacaggaatgtcagggaacctggcaagcccgcacagagctgcccacgtggctgcaggagtgagggtgttgaggatagtgggcagccctggcccctgatcaactgaggaattcatgatcactcttacagcccaattattcatgctcacaggtcctttgggcaaagcagagccagcatccccaaatcaaatgggtgaccctgagaatgtgacattgaacaagctgttgctgagggcctattgtggaatggaaggtgaaatgtggtccctgtagctggggattatgattggtgggattacggctgctggctaaacatctcgcagttgtaccgactgcaatgagagcagatgtacaggcacacagagagcaataaatggcttgcctgggaagccccgagcatccccatcagcgttgcctagctggggcctgtccacttgtccaggtgccagaactctcctggcagagagccactgcccctgctcagggcctcttcgacactcctcccctgggtttgccctccaaactgatgccaagccccaatacaacagtcacccacatggcactctcacctccctcctgaggcagggagaagaggaacacttaagacccatttaaacccaaggctaagaccacatgttattgaacatcttaaaatgtaccatatctcatgttaaatataatttttgaggtctttattatggccttaacccacaaacaaagctataaagacaaaacaccactgatggaactgtagccacaagtgctgggctctatcttctgaaccatcttatgaccctaggagggaaggatggcccaccccacattacagatgaataacctgaggtccagaaatgtgcaggaattagtacagagtagcaaggccagcaggtgacaaagtgcggttttgaacttgtgtctgcctgaccccacatgtagtgtgcaaagtaaaaactctctgtaagctatcagttgcactctctatgttgaaaatctcactacctgggaggaaggcatcactagctctgtcctagaggaaaccaaagctctttgagacaaaataattggcctaaagccacagagtgagaggcacagccaagatatgaggtctgccagagtagaaaacctgtgttttctcagcaccttgacgccaccggagactgagaccagggaaagaacataaatatgaggcatgtcgccttcatcagaagtctggggagacttgaagacaatagtgagagaaagccaaaatactacaaggcaaaaatgacttgggtctcaggagcctaggacctgcgggagagagtggtacagtgatgtaaacacatttagtgcaaagctgaccgctggccttttgatccctggtctccattctccctggagctcacctctggaggtgtgcatatacacacatttctgctcctcttaaaggactaaacaggagcatctttttaaagaagacaaggatatcgtgatcttgccacacagcaaagagactctttgagaccgggaaagttgggatacaggaaaagccacttgttccctcttgagcatgtgtgactgtcacggcgggccccgggtacagtgctgctgactagagcgtggcttgaagcgagactctggcactcactatctgggtgaccttgggcaagggcacttcattgctgagcctccatctcctcatctataaagtggaaattattacactagtctcaaaaggttgttaatgagcataaaatgaactgtaaagagagagaaaattgcctttggctaacagtaggtactccttttagagagaattgcctttcttggagaaatgcctttggaagcttgtgtggggtagaagctgcattcttggggcctcagtatcacttatgctgagactccagtggaagagaaaaaataaacccactgggggcttggatagcataagagaggtgtgagggtgaacaaatggcagaatattgggtgaagcccaatatgatcactccccaggtgatttttagatctccagcaaggccctcaaaatacaacaaagacctttgctgtgcctggatctcctgtgggttctagaaagggttgaggtcggcatgccttgggcctaataagataccacgtgggaacacagggaccagaggcaaaggaaccttggaaaatgtgctcatgtgtgttactgaaatcttgggagatgattttggggagatgatttttctactggctatgaaaattcagagattcaaggaaatctcagtttgtattccaaaggcaagaaggactctggtgaacctagagattcggtacctgcaggtgaaagcattttgtaaatctgagaactcgcattcaggaaagggaaagacaatggctattaagtagcaactctgggctaggagctacccttagcacttgtgtcctaaaaacaactcgacggtataggaagttgagactcagtgaagagatgtaacttacccagggccacatggccgagcccccattctctgggctcccatgaatgggtcagttacacatgtatgcacacaagcctgtcccgaacatgtgcaaaatcacagatgggtctgggataagaatacacattttagtctgtagccccttcccccttctccttccaccaaactgcatctcttcctgcagggggcctcacatataagtgtgcagcgacctcagtcctcaggtgcaagctctgtccacttcccccagacatccactctttggccatggcactttgcactgttgtccaacacacacttagcatttgtcacactgcccaggaattgcttgttcatgtgtttgtcccccctctcaggctgcaacagaccatgttctgtttgccagtaacctcacaacgtggcacagggtctgtcaaggggcagttcctgtgagatgaacagatggtgacctgttcttgggaactgagctcagactctctgactccacagtccttgttctgtccccttcagcatgtcagccaggtctttaagggtaatatatatatatatattttttttgcattcaagcaagagaatatcctgaaatcctattcaatggaaactaggttttagagtgtgatggaagcattcatgctttcagtccgacccctctaaacctcatctgccaaacccagcttctgctgggtaattgcctgcagcatggagaatctggggtttacattcgggttggtgcaaacaagttggaaattgctaagaaagccttgtgtgtgcagtggagattggtttgttgaatttacatcccccgtgtaaatacagccaagcctagagcctatggtttctgcctccagataaagccctgtccgtatgaccttcttgagtaatagcccacaggccaagaagatgacaaacagtgggaagagtgtggcttgtctgggaagctggaaaaccatcctctgatagaaaatcaaagtggctctacctctggatgcaccttctgtatgctcttaggctagacaacagtggccttgtcctatgccctgtactttagagagccactttggcccacttcagactgtccctcttctcggagcaagggatcgggggccaatgggctggccaaaggatctggttctgtcctctcccttctggtccaggctccacatttatgaccccctagaattccctgccacgaggccctacactcagtttcttcctttgttctgtccttcctgtgagtggccgttggcctaaggatggccaaaggatggctgtctgggggcagtggacagaacttgcacctgaggactgaggttgctgtgcacacacatatgtggggcccttgtggggagagatgttgttgggtgaaaggagaagggggaaggggccacgggctgacatttttattcctatctcagattctgtgattatgcacatgttagggacaggcttgtgttcatgcatgtgtgactgacccactcaggttttcagaaccttctccattcttactgtggcctcaggaaggcacggtggtcctcctcacctctgaaccctgctcctctttctacatcagctcttattaaagcaccatgtccatcctgaagtaccattttcatcctaatacccgagcccaccctgcaacaggtaccttcctgcccccaaatgcccctgagtcattttccacttctcacttatcaaatcctgtattcttaaagcaaagcaagggattataaatgccttcacacctccaagcctctgcccagctatttcctctgcttgggatgccaccaacaaatcctcattcaatattttcaaggcccagctccaatgccaccctttacttgtgactttctctaacagtctcccttgcccataattaatgcctcgatgacattttttttccttaacctgctatcatatgtctcccatagctcttatcagacttcagggttattgttcatatgtttggttcatgttcacctccactgccaacctgtgagcccctagatctcctcattttataactataacatacagctgctgaataaatgaatgaataagtacataaatgaataaatctagaaagtagtgatagctgaagaccaagccacccgaatttaggtgctaatagagggcaggggaaaagcaataagtagagggttgaatcaggatctccttacactccaattgttaagggtaatcatgtggttaagtcagaattggctcccttttttgttctgtatggactcagcctccatccctgctgtcaaaggcaatagctgtagaatcttctaatgaccttaatcaaggcagaacatcttattaaaaaagaagcagcaaaacagattttcaattcatgaatttgctacgtattcatgtttgcatgtggagttgcctgtagcatatgtactgttcaaagttgaacctaaattaagataatttggggatggggctgaaaatgtggaggtggatagcttgtatgcaaaattaattttttatccatttggagatgcaatttgagttcttttcaaattaaattgcaatggagtcctaggcagctggaaacattattgccaacataatttgatactgcaagagcagaaatatgttgacagatagttcgatgtgaccattaatttgcactttctgcatggaaatgatacacgaagggaataaaaaggtaaggggaacaaaaataaaatccatcttctttccagcatcatcgaaacccactctcttgcttattttccaccacctcttctaatttattgcagatgtttggtggacaagaatttgttgaatactagttcactattcctaaaccaaaaatctgaaatctgaaatattccaaaatctgaaactttctgagtgccagcatgatgctcaaaggaaatgcacatgggaatatttcaaatttcagattttcaataacagggatgttcgactggtaagtataacacaaatcttccaaaatctgaaacatttctggttcaatcatttcagataagggatattcagcctgtattatcatagatatcttataaatataagcaagcataggaatccaggagctccatttggagatgctggtaattccacaatatagaagcactagatcctacccgtgctgatgattagaatcacctgaagctggagcatgtcaccttgtgagaaggcaacacggttgctaccctcccatagcaatgccacagagaaggtaatccactcacgtgttcattgtctcatttcttaattgaaaactactcactgagcatggaggcatcatgacatggggaaaagaacattggttctgtgatcacctgaacctaagcacatcacttaccctacctgtgtctgtgccttatttttctcatgtaggaaacgtagatgatactccttcactcttagggctatgaggtgaattaagaagataatatattccagagccttggatggtactaaatacagttgcactccctcaaacccagagtgggaggtgagacagaacagccactgagacaaacaggggttgtggaggtttctgtggatctctgacctggttctgagtctagttgactactggcctcattcttttaaccaactatagtttagtgttagaaagcttccattaatgcccttgcagttattgctgtatctactccttccattctacatacatatcctgaacctctgagatgggccaggcattagggatgtaggtgaatgggacacttgcttgcctttgtgaaactgatgctagggggatgcaataattttgaaggatgatatgatgaagcttgataagtcttttgcaggggaagtactgggcttctggacaatagatacagtacagcattgaaacccagctaagccaatttgatgatgacgcatgcacaaccctgacattcgttatcatagaaaccaaagccatcaaagaaatttaaggtgaacgaggattaacgattccccaacaactgcattattagatgataataaaagcaagccttaggccaaattctactacacagatggacacagtatacaagcatttattagcaaatgggcacaaaacagctcaaacaatctatttcataaagtcccagcaatagatgaatcagttaccatttttcatgaaaggttcattcgaggcaagtacaacaatactctaaggcagaagtaggtgagcttttttttttttttaagggccagatagtaaatatttaaggttttgcacctttgcaggttagacagtctctgttgcatctttccatctctgctattatagtgcaaatgtagccatagacaacatgtacgcaaaataggtgtggctgagtttcaataaatgtttatttacaaaaagctagaaccttaggctatagcatgcttactcttgttatggaggtaaaataaatgactatgattgtcactttaggcagccggcaatcctcctaatctcatggctaacacagtactgtttaggaatcaaggttttgacaccatccctaaggtcgaagactagaggtcttacaggattattctttataatgtccttctggagagtattttaaaaccattttggccaacccacatagtttaaatacctttcatttcaccaattagaatttacttctaacatttattatgctagtccacaggcccttgatttcaaccacagtaatcaattgctaatatttagtttgctaattagcaacatggaggttgttgatcaagatatggtatcagaatagttgggaaaataggcgtgtactcatcacatctggttagttttttttaattttttttttagaggcaagtatctcactatttgcccaagcgggtctcgaaatcctggcctcaagtgatcctcctgcctcagcctgggagacagagcaagagcaagaccgtgtctctaaaagaaaaaaaccatacacacacaaacacacacacacacacacacacacacacgcgcgcatgtatatatatggttatcatatgttattttgatatatgatatcaaaagcatgtggtgtacttagagttttctctgaggtatgggttcttgactgcaacactagtgtacttatggtgtgttcttgattgtaaggctcttaataccggtactagctctcaatagcttgaccaatacaactcacccatcacaccccactgtgtaagcttaaatatttgagataaattaccaacaatgtaatatttagtctagaggccaagaattctttcctgaaaaagggaccttgggcaaaggatggataggattaaaccaggtaaaggggaagagtgtgtatagaaggggacgagagagggagaaaagggagcgggaagattaagccagagataaaggaggcagcacatttaaaatctaagagacaagagcaaggaggctaatggccacagagattgccatgcttgagtggaccgtccacaagagcaggaatccctgcctttcaccacacatgcacaccccatagtgatgtgctaggccagtctgggtgttacacattggtcctcctaccatccctaagaagaaaatgaggataacaactagggcagttgtaacagtatggtaagagtattctttgccaaaagtaaagcactggacagagtcatttgttttgtattttgagtttctaccatgtgctgagaactatactggatgtaggagtgaaccaaacaggcaaaaaccctctgtgcccttatggtgtatatattctagtgggggtaggagattaaataatatatcagataaatcagaaaagtatgtaacacatcagatagtagtaagtgctgtggagaaaaatcaaggagggaagagagactggagggttgggaaaggcttatgtctacaattttacttctttgatttgaggccttggcatcagctccttgatctttcctgatctttcttcttcatttaccctgaagtttttactttttttcccacggcttagctcgaaatattttttgagcatctatagggtggcaagctagttttgggggacatagtgttaacaaaaatagacataattcctgcctcctttgcactaaatctggtgagaaaaacagactaaaacaaccatcatggcagccaaacacatgagctaaccaaattgcatgtgttttgaaggaaatatagatgttataatatgatgataatgcaaataaaaagtgttctgaaggaaacacaagggatcgattggataaaaatggcaagctatgtacagtagtcagagaagacaactgaagaggtgacatttggactgaaaggtgtcactcttccctctctattcccacttctctcccagttttcactcattcttctttgtttttgagacagtctcgctctgtcacccaggctggagttcagtggcgtgatcttggctcactgcaacttccacttcccaggttcaagggattcgcctgcctctgcctcccaaatagctgggattacaggcatgccaccacgctcgactaatttttgtatttttagtagagatggggtttcaccacattggccaggctggtctcgaactcctgaactcaagtgatccacccgccttggcctcccaaaataactgggattacaggtatgagccatcgtgtccagcctccactcgttctttaggccttcctttaaacattagttcttccgagaaagctgtcactcaaaagcttctctcgcccagttgggtatgtgtcccaccccatcccactcagatgaatgtaaaattgggtccaatcagggctagtccaacagccctatcccataggtcctccagtcagtttggggtacagagggggaacccagagtcaaatataatccagattcacaaagcagcctattgactgaggtcatggccctcgggcccacagtaagcacaaaaactgcagcccaagggccttcagccagttattcagccattgtctttggctccaaacatgccctctgtatcttgctttacggtgctaaggctaggatggcacaaatcacatgtgctctactgtctggctgcatgctagtatctgcccatagggggcgatagagggagcctgcggggcaggaggacggggagacttcagcatcaggtatccaagtagccagttcattctgtcacagcatttggatctagcttgcagtttccccaacacttacagagccagcctcattgcagcacctcagagacaccagcaccagcctcttttcgttcttttcaaccctggcagtagctgctccccacagttgccacctttgtctagtgttttcatgttctcttttaatgttttccattttctaggcaattctttatatacagttaaccagaggttcacagtgcccttggtgttttggtaatttttttttcccacagatcctaagccaaaaaacatacccaacagtttcatgtattagttgttgcaaacaacttaataagtatttgcgtcctaacaaataagaagtggtttgagaaaacagtacacacaaatcaaaataaagctatttttttctttcttaactacaattactccctaaaaggatgcatgtatctgttgagcattacacaatttctcaaactgaagattcagattagacagacactgccactttcgttgcctgttccatgttgattttggcacaaaacttgcatttcatcatggcaattgccagaagcccaattctgccaagatatgacatcagaaggaatgtagcccaatctcatgttgaaactctgggccccttcaagtagtcatttgtagcgtgtctgacagatgatgctgtgttttccacaatactggtactaccggtgctcttgtgagttaagagtggtgtcttacactgtctcaacacagtttgaaaaccaggatagttaacaattctgtataggcaattctgtctgttataagtgtcatgatttatctccaaaatagaccttgactgatgcaggaccccactgcctaaacttccttaatattccacgttcccatctttgtctcccagtattccactcagcctaggcacctcatgcccagaaatctgatgtcctcctagctgccacattctgcttcccagctccatctcagaccttgatcttccctctctgccccatccagatgcagtcccctggactgtggctgagccagggagcagggtggtcagctgtgtgcctcctgccacatcaactgctcaagtgctcaaatgctgggaagaattaaaggaacagaggcaaaagactgcagcctgaagacagagactttggaatgtttaaaaattacttttgcgctagaggaaatcgggttgggaaaagagaagcaattttgaaattacgtggtttcagtttccagagaaaggaaaaaagatttggggtgaagaaaaggagaagtcaaacccataacatctgggttagtttcacttcaattcccacttgattcatggcaagtcgctttattcatttaaagaaattaaaggaaaagaagaaaagctggagaaagaataaaacctgaaacatttctgatggtcaaaagccacctagcactgggccctggtgaggtattaaacattctaacactttacttgtcctggctgtgaacaatagggcactggaattagaaaagtctcagcgtagctaatttgccattactgcctaagaagccatgtgtaaatcaaattgtttctagactatgtaaaaacaaacaaaagtaatatctcctaattggactctgatcgcctcccttctagaagtactacctttttttttcagctggagaatttggcttttcatattcagatccagggtttttcaaagctgaggctgctcatagctgacaactcccccatcccaggacattcttgatcttccaaggaatcacattaatctacagacactactcaggactgctggaccttgaagagccctgctgtgtcagcagccccagaaatgcctaccaagcttttttatgatgtccaaagctttattctttgaaatgtacaagagtgtcattaaactgaaggaacactttcaaatgaaaaccactgtcagttgagggaggcttattttctgtcgaatctcatttgggacttacctaggcaatgaaaaaggcaattgacaaaacaaagctgtccatctcagttaacttgtggcaaacaagaatggaaccccagtagaacacggatcacagtacaacagtagctagaagacacattatctgactgcttgcctcactcacttgcgaagtacctgctggccttgttgagcacctctcagaaaagatgaggggttaaaatgcacatggtctgtttcctgactgacccctctaataggggctgacacttggccatgacattgtgagacacaatcctagcacaggcttttacataagccaccaaatgatacttcttcatatcagaatctcaaaaatgatagctacttttcctccttgactttcatttttgacttagccttctaaggatggcctctacaaaatatagagctctccttaaatgtcatcagtctcgatgccttttccactttccatcttcctccatctgcaaatagtcttgctcagatacttgatgttttcacattttctatctcttgcacattaaaacttatttatgaactgtgtgacattgaaaaaataattttacccttcctggccccagatttatatttatacatacctcctacatttcttgtagggtttaaataaaattatatgcatgcattgttagtgggatgttgtcaccatagtgctgtataacaaatcacccccaaagccacgggtttacagcaacagacatttattctcaagctcatacatctgcttgtataatctcctggtgtggatcagccaggcatggctccaggctatgagttgtgcccaggtctgcctgatgtatgcttattctacaaaccaggttgaaggagcggtagcccctcagagtaagttctttccatgatgaatgcaccagagccgagccaagccaacccatgtaggagctcttaaggcctccctcatgtcaagcttgctaataccatattgagagagcaagtcacacaggcaagctcaacatcaatgaagccactcgtcccacagttggaaagggtgggagtagcagaggtgagtgaatatttactgaaagataactcaaactatcagatcaatagatgtgtatgttttggttaacatgaccggccaacactccttcacatagtacaggcttgatcccccgagggaggaaagtctgactttgagtcaggtgtgtggagagccagaagattctgctaaagccataagatttaagcagtttcctgttctatgttcattttaactattatggaatgtgtctcttggagagaagggcagaagtctaatagagagatctggagaagccaccctggcatttgcagtctttgtcaatctcaatatgaacattctcatctaccagccaaactggtcagatgagttcttcctgtcctcaactcccaaatgctgtctcagaccacatccctgcacacacaccctgatatcctctgccccaaatcaaaactctacagtaggcaaaaatatcagcccccaaagaggttcacatcctaatacccagaacctgggaatctgttatcttacatggcaaaaagaacactgtgaacgtgattaaggatcttgaactggggatatgatcctggattatccgggtgggccccatgtactcataagggtccttataagagggaggcaagagggcagagaggagaaatgatgttaggctgacagcttcaaggatggagaaagaacagcaagcaaaggcatagaagtggcctctagaagctggaaaaggcaagaaacagattctcccccagagtcgacggaaggaacacagccctgcagacctatctcagacttctgacctccagaacaataaatcagtgttaactgctacgcttatggtgaattgttatagcggcaagacgaaactaacacaaacctcaaagattgctctgcttatttctgtatgtttattgacactcttcactttcactgccttccttctgtagacccattatgttttatacactgtcttctgcccgaatgagttcttgtaaaatacatgtaattgtttactatgcatgtatttttaattatgtagattggaatgtgttctagctcgtttacctttttgtcactcagcactacacttctgacatccacccaggctgctgtgtgcccttatttcatgattttcaaccattgcatggggttctggggtgtgttctctccatcatttatcaatctgctccccactgacagacactgtttgcttcttactcatcactgtcagaaatcacactgtagtagaccttctcaggtgtctccttctagatttgtgtgaattcctttgtggtctacattcctaggggcagaaatactgacatataggctgtgtgtaaacttaatttgacaaagtactgtcagattgctttcagaacagcagccccaaaacttttagctgtatgtaaaggtacctgtgaacccacattcatccaacctttggtattatccaatttttctacctttttaccaatctgatgggcactacgtattttttaccattactattttaatttatattgtttcagtactaaggagtttgagaatttcttcctatatttttcagccttttggatttttatctttataaactcgttgttcaaatcctttgcacaatcatctactcatttgtagaattctttgtatattctaggggttttttttgttcatgataatctctaataagtaagagtcctttatttttgatgtaataaaatcaaccaagtgccaggcgcagtggctcatgcctgtaatcccagtactttgggaggccgaggcgggtggatcacctcaggtcaggaattcgagaccagcctgaccaactgagaaaagccccatctctactaaaaatacaaaattagccggacatggtggtgcatgcctgtaatcccagctactctggaggctgaggtaggagaattgcttgaacctaggaggtggaggttgcagtgagctgcactccagcctgggcaacaggagcaaaactctgtctcaaaaaaaaaaaaagaaagagagaaagaaatatgaaaaataaataaaatcaaccaagtttgtgtgtgtgtgtgtgtgtgtgtgtgtgtgtgtgtgtgtgtgtgtgtgtgttctttgctgattctcaaggttttattttatttttatctttttacctttttttaaattatactttaagttttagggtacatgtgcacaacctgcaggttagttacatatgtatacatgttgttatttttttgaaatgtctccctaatggtagacatgaaatctgttctcaaatattccacgtcccccttgttccaggcacatggtcaggttgtactttcctttgaagttaggtatagccatgagactttccttgcccagtgataagtgagaagatatcacctgtcactttcaggactgttttaaagcccaagtgtaattggcccatttcactttcccctgttgacctatgtgatcacaacacactagcgagagagagatttctgttgcgggttaagccatcagattttggggtcatttgttcctcgagcatacctagcctatcctgacttttttttttttaatttattttatcccattccccactctcctaccatgagcaaccattttaatatatttattttgtgttcttagaaaatgcatcctattacatgtgcatttttaaaatttagataaatggtgttgggttgtctcactgtttcttactttattcactcagcattatgcttttaaggtccagccacactgctacaactgcatatcaaatctgttgttgttaaatgctgtgtgggtgagccacagctgtgatttccctctcttcctttccctatgaaagacacaaactttttttgaagaaatctttgcccaactctagtctacaaagtcattctgcaatattcttttctaactttgtagctttatcattcacactgacatcttaggtctccaaagtccattaccctgggagtaggtattaaggtggcattcagttttattttcccctgcacagtaaaaaaagttttcctcaaaaccatttgcttactattcagtccagttgatctgtagagccatctctatcacacatgaagtttccagacatacatgaaatggttcttgagctttccattctgttctattgatccactgcctattacagcatgcatttttatagttatggcttaatagtatattttatagattcatgtatggaagggtacatcttctgtgtttttaatccctccttgaagttgactactatgatttttcccctctatatatatttattagagaaagtttatcaagttcgttaaaaacttaacagaaatttttattgacactgaattaaattcatagataaattcaggggggattttcacttgtgtaatatcttcccatccatggccatagactttttctccatctattcaggtcttcttttaactctcttattaaagttttctccattgagattttatatattcttagactacttaaatcctaaatatttgatcatttgtattacaattgtcttaaattagattttctagttcattattgctggtgtacagacatgctattgatttttataagttaatcttatatctggcaaccttgttgaactctcttattaccacaatttttgattgcaattgatttttctaaaaggattatcatatcatctacaaacaatgagttttatttctttgcaatcctcatacatcttatttctttttctttccttaaagtttgggccagaaactccagcattatgttaaatagcaatggtggctccactcttctccctgctccaaaaaggaatgcacctgcattttctacattaggtataatatttgctgtagaattttggcttataaactagcaatctaacaaaagtttccctttattttctaagggttttaaaaaataatcataaattggtgaatacctttatcaaatgcttatcacctattcactcatttaaggacatttaagttgtttcaagtttggggtaattataagtaaatctgctatggacattcatgtatcaaatgcttgtctcaaggattgaaataatcatatgatttttattctttagcatatttaaagtagtgaattgcacgaacattgaaaaaaaacttgctcctgggataagccccatataattattatttttgtaaaacagtgttgacttcgttagttagtatttaacatacgatgtattttctatacattcacgcatgaaatgggcctgtattttcttttcttgtattcttatctgatttttcagtctgataaccaagagggctactaagcgactaataagtgagtagcatatatagcatggatatgttggacaaatggatgatgcacattctggcaggatggagcaggatggcatgaggtttcatcacagtattcagaaaagtgacatttttaaaagttatgaattgtttatttctggaattttccatgtactatcttcacactgtggttgactgtaattgcaaccaagaaaagtgaaactgtggatcaagggggaatactgtgtcaagaggtggagcctttaggggtccaccttcaaagatgggatcagtgccttagaacagggcttgagggggcaagttttcttctcccgtccgtctgccatgtaaggacacagcgtttgtccaccctggatgataaagcaacagcgtgccatcttggaagcagagagtgaatcctcgtcacacaccaaatttgccagatcttgggcttcccaacttccagatctatgagaaattaatgtctattatttctaaatcacctattctaacatattgtgttataccagcaggaatagactaagacacttatgctatctttttatagacacaccctttctctcctccctgccatctaaaaccccaggcagccactaatctgttctccatctataatttttttatcatttcataaatgttatataaaagaaataatatactatgtaacattttgactcagcataatttttcacttagcataattctcttgaggctcatccaaggtgttacaggtacaatagtttgctctttttattcctgagtagtatatcatgctataggtgttttacagcttgtttaactattcactcatttaaggacatttaggtagtttccagtttggggtgattgtgagtaaatctgctatggacattcatgtataagtttctgtgtgaacatgagtttttgcttccctggaataaatgcctaagcgtataattgctggatcatatagtaagttcatttttacttataaaataaacaggcaaagtaccttccagagcggctatatcattttacatttccaccagcaacgtaggagagatccagtttctttgcatcctcgctataatctggtgctatcactactttttatatgagccattcagataggtgtgtagtgattcctcactgtggttttaattttcattttcctaatgactaatcatgttaaacattttcttcatgttccttttttttgccatctgtatatacaggtcatttgtttttaacttttgtttcctgttaaataaatttaaacttttagactttcctctaagtgttgcttcagcctgttgtgcaaatatagacttgttctgctttcattattattcacttcaggattcctttatgatttcctttgtaaccaaagtgttgtttagtaacatgttatttagttgtcaaattcatgagatttttaaatctgtcctttggttattaatttctaagtttattgcataacagttggggaacatgctctgtgttatatgaattatttggttttaattgggctgcttttatggcctaatacatgttctatttttgtgatgattttgagtgtgctcaaaagaatgactttctctgtttgcatttggagttctatatattaaaattatttaacactaatttgtcaatatgttaataagcttgagtttattcattctatttctcagatcttcaatgtctctagttattttttgtctacttgatattgttctgcttcaatagattgattccctagtatggctgctaacttgtatccaccttaaatgataaccacaaaaacaaccataatttgcaaatacctaactgcctcatgtaaagttttaaatactatgtgccagggacttggctaagcattttgctggtgtcacatttacctcttacacttacaagtcacaaagttcctgttttacagatgaggaatccaagagtctagaagcaaattaaccatggcatgcagccagaatggcagagctggcatttaagtgcagatttgtgttctaagtccatgtttttaatgattgtattctatgcctcagtttactcatttgtagaaggaggaaatttggaggactttgaggggtttttttttaagactaagaaactcatcatcattattattgtctgggttaacatttattgaactcttcctctgtaagttctaggttctgtactaagcacagtacgtcagtgatcttatttcatcctcacagccaccctataaagtaggtgttgaaaacttagtgttacagatgaggaaacgagggcttagagtgagtactcagttaggataagaactcattggtgaggtcaccagggcctaaggtcctaatcacaatgctagactttgatcttccacactgaaccggggactttatagatgacatttcacgtagccccacaacagctgtcagagggaagaagtggtgtgccttcttaaccacatccatccaaaagttttttggttgacccctgggacttcagaaagaagtcttctgtctttcttatttgattgaaatgttcctttcaattgcttggactctgaagcccagcatcctctttttctctccccaagctgctcaacacattcctaaaggcagcatttggcccagctcatttcttcctcttcatacccctccatttaacctccccatcttcagtggaggtacacatactcaatcacattgcccatcctctcctgttgtcttccagaaaagtcttaccctaaaatggactgataagcccatacaacttatagtatattttaaatatgaagataggggcttttctcaatcatctcgaccctttcatctacctgtttttttcagagtaaagagagagaagcagtgagttattgtcatgttaagctgcactaaatggctgtatattatggttagagacctctggagaaataatgatgagatcactgcatcttttgttcttggaaaaataatgtggcaaaaagacacctctaatcctctattttaatttgtttttattgatctctttgaaaattagggaaacaacgttttctcattgcaaatgttataagaatgcatggggaggttctagttataaagaataatgaagtagaggctatgaaagagagtctcttcataaggcatggatttagcggaggacggtgggtgagaacatacctgtaaaaggaaatacacagagtaaagaaacctctcagatatcaatgactaactctcagttgtgggtttgggaataatgtgtcatcaaagaggcattccatgagctcagtaaaaactcccgcccctcccccaactatcatttcactatcatatcaatctcctttattctcttggcacttgcaggaattaccttgtttatttacttatatgattgtttacttgtattatttcccccaccttagcctgaaaaattaattgtacaaaagaaagaactttgtgtatttgttttctgccatttcctggtacctagaatcatagctggcatataataagtagtcaaatatttggacagatgaatggatggatgaatagatggatagatacgtgaaataaatgtttcctctatccccaatcttctgtgatttccaaattttctataatgaacaaatgttactgctctaaaaagaaaacattaatttagcatcacatctttctagaaacctttcctgtttcctcgggcacaagtgaatctccctcctctaatctcccaagaatattcaaacctctcattggacactgggccttgtcatcctgactctcattatttgcctacatttcttgtcttcctcactgaaatttaaggcctctgagtgttagactcataaatttccagagcagcaaagaacttaaagatcatcaggcctaacgtccccacttatagatgaaaacagtgagactcagagatgtgagctatccagacccaatggcaaaagataatccaggaaagtgctacactcttaatgccatattttctttgttcaagttgtcttaggtcactgggtaagctgtggtaggttcagcactttaactgggcacctagccctctaccctctcttctctaggccagagggcagtgccttctgcatttgcaattcatatttcctacctcagtggctgaaaggggcagaaagggctggaaagtggaggagtctcacctatactttctctctttatttggcatgtccatgcacctggcatcctaccctttatgcccaaagaattaacaaggagaagaagaaataaagcaataattctctggcaactgtcaaaaggcacacagaccatccacaagtggtttttctgataaatatgtgcaaagcctctttcagttttcccgttagagtctcagcgctcccttgaggaagaggtagctcaattctaaaagaattttagataagctatttaagacataggggaaaatacaggttaaaatataacaaattccccaaacctagcacctaagatactgaatttagggttcagcatttccatgtaggtatccatgtttccttttcatatataagtttctaagaataacatagtattgactggcagacttaaaaactacatacagttgacccttgtatataatgcaagggttagaggtgccaacctcccacccccacacagttgaaactccatgtataacttctgacctccaaaaactttcctactcttgaccgaaagccttactgataacatgaacagttggttaaaacatattttgtgttatatgtattatacattgtattcttacaataaagtaagctagagaaaaaaatattattagggaaatcataaagaggagaaaatctatttactattcattaaggggaagtggatcatcataaagctcttcattttcattgtcttcctattgactggcctgaggaagaggagaaagaagaggggtcggctttgctgtctcaagggtggcagaagtggaagaagtggaggaggtggaaggtgaggcaggagaggcaggcataccccatgtaacttcacaaaaacacattgcaatttgtctttttcacttttttatttctctcaaaaatgtttctatgtggtaccaatttttcttccacctcttgctttagtttcagtgcctgtttcacagaagtttccatgtcctaaaagaagtcaaaagtggtcttgaataattggaaccgttctgtcagataatctaatgtaaatctgttttctggcaccgctccttctatgtctttcctcatcttctggcaccagttcagaagagctcatctctaacaagttgtccgctgttaattcttatgatcttgtgaagtgtctattagctcctgaatttctccaagatctgtatcttgaaatccttcactttcaccaccttttttttttttttgccatatccacaatctctttcataatgtccttgattgcttcggtcataaattctgtgaagtcacacacaacatctgcacagttttccctagcagtaatttattgtttcaagcgtggcagttttcatggttttttgtataacgatgatgacatcttcaatggtgtaatcctttcagactttcatgggctctctttataccgttgacaatgcattccatagaatacaatgtgtaatgaaacttaaagatcctcatgacccctgaattagagacgttgtgtttgggggcaagcagaccacttcattgcctgtgatgttcaactcattgggttctagggggccagaggtattgtctaatagcaaaataaattcaaaggtagtcccttaccagcaaggtacttcctgacccagagaacgaatggaaccaattcagaatttgttgtccaggacttcttgtacaatcagaagtctagcagctggtgtttatcttttcccttcaaggcttagggcttagcagctttacagataagggtagtccttgtcataaacctgagtgcatttgcacagaatcatagatttagcacatctcttcctgtcttaaatcctggtgctcacttctctttcttataactgaatgtcttttatggcatttttcccccccagaataaggcacattcactggcattaaaaacttgttcaggtagatatcctttctcctcaattattttcttaatggcatctggggtattgtctgctgcctcttggtgggcaaaagctgcttctcctgttatcttgattttttttggtttgtttgtttgagacaaagtctctctgttgctcaggctgacctcaaactcctgtgttcaagcgatcctcctgcctcagacttccaagtagctgagattataggcacccaacattgtaccaggctcttttcttgacatttttttaaacgaaatctttttcaaaaattaacaagccaccctttgctggcattacataccccagctttagatcctttaccttccttttgttttaagttgtcatataataattgccttttactccaatgatattagagtctacagatatgcctttcttatagaaatcctgcaaccacataagagccgcattctcaatatgatataaaaaggtattttgcaaaaagtgcaaggttttcatgcatgctggtatagctgtggtgatcacttcacaaatttccttttctattctttttttatttacaatggtccttgtgctggattcatttatcttgaaatggcagaaaactgcagctgtagacctcaatctagggtacatatcaagaatttaacctttcttttgtaatgtcatgacttttctctgcttctttggagtgcttccagcatcactagtggtactttgtatgggtatcacggtgtttttcaaggtttacactattgcaccaaacatgatgaaaaatacacgagaacctcaagagatcactttttattgtggtaagtgatgtactggaaagatgaactgatcatatggagatgtcagccttgtaaatcgaaaataaaattctaagccccccagtcaactgaacagactttccttttggccaaagagatcccccaaaacctgaaaataaactagttcaggaaggcagggggcaggggcggttggacatgtctcattacaccctcttccctctggaggttagacaaaattgactagtgttaacattaaaatagagatcttaaggactgacaaaacagactctgtagcaataagacaccaaattccaacctgattctagtgtaacatcacatgacagatagtgggtcctaaaggaaatcaaagtattttgctccaaaatatacttccctgacatattttgaaatgggcctgaaaagctatctcttgcgggggaagttatattctatagagactctccttcccctacgaggtcttttcaggagattttgacatcttttagctctaataagaaacatgcacatctattctctctgaactctgctacttggaggcttcatctacatgacaggaaccttggtttccacaactcgacctctcttaccttaccttaactcaagctgactcaactcttcaggaagagcttaattctttcaaccaattgccaatcaggaaatctttgactccacctatgacctggaagccccacactctacccggctttgagatgtcccacctttccaggccaaaccaacatataccttacatatattgatttatgtctttgcctgtaacttctgtcttcctaaaatgtatacaatcaagctgtaacccaaccgcctttgggacatgttctcagaacctcctgaggctgtgtcacaggccatgattttaaccttggcaaaataaacgtctaaattaagacctgtctcatactttttggtttatagcctcaaatggcattttaaggagatactcatgacatttgaactcacagcaatagcaacaggaagtggctacaaaattaactgtagtacatactgtactactgtggcaattttgtgcagttatgatctaatactgcatctttatatttgcttacatttctctcgactgcaaatggtgccatgtacagtctgtatatgtgtaagttttgataaacttttttttttttttttgagacagagttttgctcttgtcacccaggctgaagtgcaatggcacaatctcagctcactgcaccctctgcctcctgggttcaagcgattctactgcctcagcctcctgagtagctgggattacaggcatccaccaccacacctggctaatttttgtatttttagtacagacgcagtttcaccatgttggccaggctggtcttgatctcctgaccttgcgatccagctgcctcggcctcccaaaatgctgggattacaggcgtgagccaccatgcctggccaattttaactttttaataacagattttagaatattttatggtagcaaatgataaaatagactactatctacatctttcatgacatacttaaaaattttttgatttttgatatttctgggctgcatgatgcgtctgcaagtttttcaaatcattgcacacctccaacaagatgtccaatatatgtattgaaaataacccttgtataagtggatgctttcagttcaaacctacattgtccaagggtgagttgtaattggtatcatatacatacccttcttcagcttctatcattttagttagattcattcattatgatacatggagcttaagttcattaattctactgctatccagttttccattgtatgactatatcacagttcattcattattcttttgatgaatatttattttaatttatttttagttctgtttgtaatttgagtttttttatccactaacatggtatgtctcttaacttacctaggtcttttaaaatttatttagcataaattttataattttctaggtcttacacatttttcacttgttttgatatatgttttatttttgttgctactgtaaatggtgtttttaaactttttatttgaatataaagtacagagaagtacacgcatctctgaatttccacaaacttcacccttgtataaccagacaaaaatcaagaaagatgttaccagaatcacataagcctctttatgccggtctactcactacccccatcagcaaggtaaatgctattttaatatttttgaattaaattttataattattatataaaaatgtaaatgacttgtatactgatctaatatccagagactttgatatagcatattactatttataatttgttgtaatcaaaaatttgatttatattgtaatcttttttcctctctagacaatcatgccacatgtgactagtataacattgttttgcttcctttccagtaattattcattttactcccctttaaaaaaattctctgcccttactggctgtctttaacaccaagtgaaatagatgtagtgttggtgcatcccttcctcactttcccttggttttcaaggcaatgttttcatatttatcatttattatgatgcttattgactgaagatgtccctcatcagaataagaaagttcttttctattcctagatttataaggggtatttttagtttaatgattttatgcacttagcaaataattttatgcacttaggcagctataatttttctattttgtttgattaatgtggtaattacattaatgtattttccaatgtcagacaaccctcatagtctctcaatgaacccaaaattgccttcatctatttactatttttacttcttaagtttaaacttttaattgataaatacaagcaggtcataaatcataaaaaagcagcaaggtgaatttccacaatactgacatctcctatgtaacagatcgataacaaaatattaccagccctcagaagcccaccccatcacgcctttccccgtcactaacccccacaagggtagccagtatcctaattgataacttcattgtttgtatttgcctatttttgaacttttatctagaataaatcataagcatctgctcttttgtgtcatttgttcaaccttaggtttgggagagtccaccacagtgttttaagtaacattacttcatccattcccattgctgtataaaagcgcattacatgaatatcccacatttattcatttattctattgttgagaaacatttttgtttcaagttaataaacattaggaatagtgctatcatgaacgctacacatattttgctgaagatatatatgcatttctgtgagaaatatacctagaagtggaattactggggtgtgggtagtatatatttactttctatatacaccaaggatctacaagctacaacccttctcttccgcctgccaacaatttttgttgataaagttttattgaaacacagccacacctatttgtttatgtatgtctatgctgttttagcacctcagtggcagtgttgaatagttgtgatagaaacagtacaacctgcaaagcttaaaatatttattatctggtttttacatagaaagtttgctgttccctgttgtatactgtcaaacagtttttaaaagtggttataccaatttatacccccacttctctagctttgccatgatatgttttaatatgcattcttgaattttgttcttatgtataagtgacattaagctaatatgccttcattttttttgtcctggtgtggttttgatatcaaaatatcctagacttacaaaatgaattaggaaattttcctatatttttcattctctgaaagagtatgcaaaaagaaagaaagaaattatattttctttgaatgcttggtcaaatttgcttgtaaaacaatttgggcttagcattttgagaagattttcaattattgattcattttttaaaattatattcattttgtttacttcttgagtcagttttgaaagttacatttttcaaggatatacctttttagtctcacttattgacaaaaagttattatattcattcatcattaagtattttaataggaatcatttcatatataaaaagagcacttacaaagtatatgtagtgaaaaataaaattcacttctgtctatgaaacatcttccttaagaaacagaacaatatcaatacatttgaaattcacttgtgcccctccctacagtatccacttccaattgcttttggagggataggcactctcctagaaaaaattacatatgtatacaaacacacacacacacacacacacacacacacacacacacacacatctcaaatgagatattcaaatattattggaatatattttgcacgtttctgaaatatatataaaaggaagaatatcacatatattcttctttgccttgcagttttcactaaaacttcacgtttttgacaacagttatccatattgggtaactcatttttgtgctggcttactcatttttactgtcttacaagatcagactatatgaatagatataaactattaatacaatttactcatcaattctccagacataaacatttatgttggtgccagattttttagctattagtgagcaaggctgctctgaacattcatgtatttatctcctgagagtacatgtgcaagagtttctctagtctaggctacatatctgtgagtaaatcactggatgttatgttatacacatcttcaatttaatagatgattgcaaactgcttatccaagtggttgtagcaatttgcattctcatgaggagtatttaaatatttgctgttctaattaattgcaaatacttggtgtttcaggctatttggttattaccaatctgtaagtttatttcttggacttttaatattagctgtatgttaaggtatcctcttttattcctaacaatttttgtttgtgccaactttttttctggagagaaaaaaggagtttggtgtgtttttttatgccttttcaaagagttttggctttgttgatacactctgttttagcttttcttatttcattgatgtattctctaatattagttatatcctctttccattacccttaggtttaatctattgttcttttttaccgtaatatgattgcttaaatcattaaatatttggatattcttcattactgtaagcatgttaaagctaggaatttccctgaaattgtgagtttagccaaatcccaagagttttatttgtattatttttatgatcattcaattctaaatagcttatctgttgcctttaagacattttcatgacataactattttgtaggagtgctttcaaacttccaaatgtataaactttaataaaagtaaaatttttgcttttctttctaacttgatctcattgtgattagagaatatagtttgtgtgatgctgactcaaaatttttgagacttgctttattgattgatttttgatttttgtaattgttttatgtattcctaagctaaatgtatattctctaatctcggagtgcagcattttatacttgtcaactggattgttcttattaattgtgtcatataaatcttttctttatttactagttatttgtctactttgtctgtcaattacagagatgtatctggtatctccaagcattcttcttatgccttctgctcataccagtctccctgcttttcttaaaacaggccaagaactctgccccttcagagccagtaaacttactgattctaccgtttggaatgattttctcaaatctataacctgattgactccctcacttcattcaggtcaccttatgagggaatcctaccttcatcacaatctaaacaatagctcccttgctccttaattttctgtccctttaccctcatttgttttttccttttcagcccttaccaacatcaggcatattaaatatttttttcattatcttttccatccagaatataagcttcaggggaattgtgatttattcattataatttcctcagtacctagaaggatgcctggaataaaatagaggattttatttttaaatgtttctaataataaaatgttattggtaatcctaattatgtgtgggcccaaactgttgcacaacaacttgtgtaatcccatctattcatttattgttcaattaattcttgttcagcaaacatttgttcaatgaatgaatgaataaatgaatgttaaaaaaaaaccatctcactgacagatttgcaatttcctctttgcaactgtctcaaatttggctttacatattttgagatcaagttattatgtgcatacaggtttagaattgttggaactttcagaataaacaaacattttataactgaaaattaaaatcttattttaataaaataatttatcattttgctttcagtctaatttatctgatattaataatgtttcatcaacttttttcctattaccagtttcctgctatatttttcccacctgtgacttccagcctatttgcattattacattttatgtatgtgtcttttaaaattgtataatttggattttgttttctaatcaaatgtaacattttcacatttaaattagggagtttagtttaagtacattttttgagaatactgataagttgaaaattctttctcacatcttacgttgtcttgctttttaaaatgccctttccttcctttccagcctttctttgaatttactgagttttaattatgttttattataaatctagcctttggtcctccaaatattttactaggctctgcaggtcagtagaaataagttatgcatacacatctgtgaaatttatgcatgcaaatagcctccattcgataggtccgatattctgggagctgggcagagcatacctacgatatactatttcatggaattcaaatcccaatgaccccctataaaaaaggcactttcaagtttctactgaacttgctcttccctttctttcccctcttttaaccccaaccaaacaagttagccattaagcctactgctctgtgtatcaagtgattcttaagttacgtaaatatgcctggtagcattcacgacttcattcttttaattattttatttacttagttttattttattggacagcctccaccaaccctctggaccagaataagttcagagctactcctgtctttattattattattgttattttgagatggagtcccgctctgtctcccaggctggagtgcagcggcgtgatgtcagcttactgcaatctctgcctcccaggttcaagcaattctcctgcctcagcttcctgagtagctgggattacaggcgcccaccaccatgcctgggtaatttttgtatttttagtagagaccaggtttcatcatgttggtcaggctggttttgaattccttatttcaggtgatccacctgccttggcctcccaaagtgctgggattacaggtgtgagccaccaagcctggcctcctgtctctactattttaaatagccaggtgacaaattgaactcttcaattatttgttgaaatgacagaattttagggtcatagaaggagggtgagtttcatatgagcaacaggaactactggcttaaatgtgaaaattaatgcatctctgcaaatcaagctgtggctatctctctgcttggtctccaaaggacatatggtttacaatcctctgtgacactgaaaagagaaaagaagcaagactatatttgccatttgactgcttttcattggaattggattaaagcatatttcactttgttcattgtcctttttaaagcattcagctccacgaaaggttgagccagagcaagtagttgaaaagattttctatgcccctttcctcccgcgttgtatgactggtggcaataaagtcactttcaggcagaaagatgcaaagccattaactcagggttacatacatcccaaaccaggctcaatgggaagaacacatttgactgtctccttctgtttatttagccatcttcttaacatttcttttttggtgtatgttttatgtacccaaattgtatatgtaatgtacatataatacattactctagtaatgtatacatacatttatcaataagtatgtgtacatatggggaatatgtgctcagaaatgttttactaatttgatttgtgatttaaaaatgagtacactggtgtgtgtgacagatttggaagcctggtttctcatccacacacttcaataagcatagccctatagaccctctcaggtgtattatcccagttcatatcttgggccttctttattgacttaattccttaaggtgatactgatgctttccagttgaatctatttccagagtactttcctcctatcttctcttttttctttaatccctttgtccaaggcccagattactgccacttaaattcagttgtatctcttacctttttctccattccaggttgtgaacaatgttgcacaataatttgtgtaatccctgaatatatctttcctgacttgagaaaaaaatgagaatatctttcagtatcagggctccttggaggtcagggacattgaataatggatggtattattcccattatttatgtgaaaaaaaacactgagattaggtgatttttgtgtaaggttacagaatcaatccgtacgtttttaacctcaccttgagattctgagtcttgtacttttccctgctgggatcctcagtgagtctatgttttctcaacctctgaccagaggctatgcctgtgccctgtccttgtttttcatatggtaaggaaaatgtcctcctggatcctaggatctgaccacatcttattaatagagttcaaggcagtagaaagagcaaggtctttgaaagtagacagaagtgcattcaaatctcagctcccaggtccacataagttgtgagacctcattatgcaggagtaaaaacacgccccaaatcttagtggcttgaaaaccaccaatatttgtttcccactcactttatatatccatgggcaggttagaaggcccaagatatgaattgggataatatacctgagaggacctatagggctatgcttattgaatcgtgtggatgagaaatcaggcttccaaatctgtcacacaaaccagtgtactcatttttaaatcacaaattctaattatatgtggacccaagctgatgaagcagatgccagaggaggagcacatggtgacccataactagctctttaagcttccatggagatgagacatatgtcacttacactcacacggatgcacccaacccaagaagggagaagccttcttggccgagaagggaaagcccatcgtgtgctcaggaggagaaccaaaaacattggagatacaccactcataattatcacgccaatgtatttagcatctctgagccccagtcttctatgtaaaaacaggacagtgataaggatagaaatataataaatcagaactaatgtcttaatacatgaaatgtacagcacaatgcttggccagcggttgagtcttaacaaatattagttcaatcctgtctgcattttgttcctttctctctagacctgagaatagagggaattggtaggaaaatgccagcgggccggtttctaattccaccaagaagacaaggaaaatgggttgcaacagcagccagaggacagaaggccagggtagccggtcaggtcccagggatcaggtagaatttcattactcacaggactttttttttttttttcagcacaaaataaccttctagaaaacccagctgaggagaaagttcacaaaggggtcacataggtagcccaagctcttcgaggtcaatgcatggtgtgcctcttgatgcagcctggcactttcattaacgtatttaatcatgcttttatctttaatcatcaaatggcttaatagcatgcattgtattcccaggcctgaaataacaatggttatgtggctctgtgataaatgtttttaataaaatcagtaattaccctttttgtgtgtgtgtgtgtgtgtgtgtattatattaacatctttccatttccttaattttggcttttagatatgcaaaaaaaaaaagactaaggtagaatactcaaaatactgttttatgtttggttttgtttctaggagcgcctgctgaatagcaggaaaggtgaattctaagctgtggattttaatgcaaacttcatctaagaacagttggggttgggagagagccctggcttcagggccaaccaaaggtggggtctgaatcccagctgtatgagagaaggctactcataggaactctccaagctgaatttccaaatctgtaaaatggtagagcactattctttataaagttgtggtggagaatataaagatgcttaaaagtaattacatttaacaaaaaatagaatagcccttactatgtaccagaagctattctaagtgacttataaatattaactcatttggtcctcaacgcaaccttaccaagacaggtattttgagatgatagataaataaaaagagaggttaagtaactttcccatcgtgccatagctagtaagtagtagagctgaaattagaacccagacaatctgcctagagaagtacattcttgatttcatactctaaacaggtgagctattattactgttgttattggtccaataaacatatttttacttaatagacctggcttttgtactggaaactctggtcattgtacatttaatgatggctgtttatccttacacttaatttatatttaatttataaatataaataatataatttataaatataaataatataatttataaatataatttatatttaatttatagatataaattatataatttatatttaatttatagatataaattatataatttatatttaatttatagatataaattatataatttatatttaatttatagatataaatcatataatttatatttaatttatagatataaattatataatttatatttaatttatagatataaattatataatttatatttaatttatagatataaattatataatttatatttaatttatagatataaattatataatttatatttaatttatagatataaattatataatttatatttaatttatagatataaattatataatttatatttaatttatagatataaattatataatttatatttaatttatagatataaattatataatttatatttaatttatagatataaattatataatttatatttaatttatagatataaattatataatttatatttaatttatagatataaattatataatttatatttaatttatagatataaattatataatttatatttaatttatagatataaattatataatttatatttaatttatagatatataaattaatatatatcaatttatatttctattcaaactgtttgtgttgtaaggtgttccttattcatttatcaatgcccgatatagaattggcctttatttatactcactgtatgtcattctgcagaatagctcaggattcttttaagtaagtctcatcctctctacttatattgttgaaggcaaatcactctgaaccttagttcatctctctgtaaaattaggctacaggttgtacctgctgtttcagactgatgtgtcttatttatttagcaaatatgtattgagcatccacttagagtaccatacccattcctggcgggaagtgtcttggtaattttaatcaatcctgacataccacccacagggacctctgatcatatagataggaacagtcttggataaagaaggaacctgggctgtgaagtcagaaattgagctcctccacttgtagaaggacatgtcacctcacctgaatcctatctgtaaaatgggttgacctaagagaacaagaatctgagaaggaaaaatacatggcatagtgctgggcacacatcaaggacaaagagggagactgtctagtctacttctaatttggttttatgaagcccaagagacaaggacacatggtttgctgagtccaaaagcaccatcatgtgcataagttcagggccccgttgtgtttccaatacctaaccccccttgaaaatgccccaggaagaattggcttgtatgaccacagcagtcccagcaaatttgcaggatggtgcagtcctacagcccttccctacctaggaacaaaagtttgtagcctatattcttcttgaataataggaattatttattttgaaatgtattcctggaactttgcttgggttatagttttaacttccataggcatgaattcacatgctataacgtgtgtgttttttaaaaaaggagccccaatacagacctgctcacagcaagatgaagggtatttactgggtcatacaagatgtgctatggtgtccagataagagctcagaccccaagaggaaagttatttttccagccctaaaggatagagtaaaacaacctttcccattatcttgctaggcaagaaaccaagacaaagcggtagaactaaggggtggcaggcaagaatatacatacaaattacacagactggaagtaacagaaccgtggagtcctgcaagcaggtggcaaagccatttctctctattcatcgtgcagaataaattaggggaaagccacatttcccagccagagaagcaataaaaatttaaaatgtaaaataaccttgagcaaaagcattagcaaaggccttgcctgttgctatggtttgaatggcccctccaaaactcatgttgaaacttaatccccaatgtggcaatcactgagaggcgggcctttaagaagtgaatgaatcatgacggctctgccctgatgaatagattaatccattcatggattgatggattaaggggttatcatgggaagggaactgatgactttgtaaaaagagagagacctgaggtagcacattgcatattagtacagttagcacatggccacatgatgctccatgctgccttgggacttctaaaggagtcctcaccaataagaaggttctcaccagatgtaccctctgaacctcagacttcccagtctctggaactgtgagaaatcaattttgtttctttataaatcacccagtttcaggtattctgttataagcaacagaaagcagactaattaacctgttctgcaaataataataaactcttgatacaacagacttatcctagccaagactagtgtgaggcagtaacagtgggaagtctaggggaatggagaccaggaacactcaaggggaagagaaactcgaaggaagccaggacaggacttttgtcttatttggagttgattgaaggctttcaccaaatgcactgaatatagtactcatcgtttgtggacttttttttttttcatgactatggtcaagaagttgagggtaaaatgtattccttttcagtcaataatttgaatctgatgctattacttctggtgtggttccttaactaggagctcgataaagatcacgaaacacatgtatctggagatcaggattagatatgcccaacttaactcttactctaatgattttggtaccaaatgagtaataactggtaaacaccctattttttttttttagataccaatgtcttggcaaggtctatttccttctgaaagggctacaccctgggcctttgcagactcgcctcctgctttctaaatctagaccaagttcctaccaatgacagcaaagcactccattctatagcaacctcttttcttaacttagaacgtatagtgtgtacattatcattcaaagtttgtacatcatgaatgaacaaggaacaacattccaaaggcaagaagagtaaataggaaaggttctattcctccctctccctgagctgagccatctgtcttgtttctctccctggaggcaactactcatagcaattttggatgcaaccttctaaagatattctttacttaaacatatataagtaaatgtttaaattatcataccaaatattcatgaaatttaatacacaatttatataaatttctatgaattttaatacatatatagatttcatgtaaccaccaccactatcaggatacagcatggtttcatcattccaaaaaacttccttgtactatccttccatagtcacagtgtccctaaaacttcccacacaactcctaacccctggcaaccaccgaactcttttctgttactatggttttatctttttgagaacatcacgtaagtggaatcacacaatatgtaggcttttgagtgtctccttttctcagtataatgcctttgagattcatccagttgtgtgtattaatagcttgtcccattttaattgctgagtaatattccaacatgaggatgtaccacatctcctttatctattaacttgttgaaggccacatcttcttggtgattatgaatagatctgctataaatatttgcgtatttattttggtgtgaacatactttcatttatctaggataaataaccagtatttgggttgctgggtctaacaagtagtacgtgtttaatttattaagaaattaactaaatgttttcaagctgactgcatacactgttctgcattttataaaaatcagtgatgcatcctaccaatcattttggatgtgtcagtttagttagatctacctcatttaaaaaatcaggctgcaatgttttaatgttgtcattgtgatgttttttgttttttgttgttttgttttgttttttgagacagagtttcgctcttgttgcccagactggagtgcaatggcatgatcttggctcaccacaacctccgcctcctgggttcaagggattctcctgcctcagccttttgagtagctgagattacaggcatccaccaccacacccagctcatttttgtatttttagtggagacagggtttcaccatgttggccaggctggtctcgaactcctgacctcaggtgatccacccacctcagcctcccaaagtactgggattacaggcgtgagctaccatacccgacctaatgttgttattgtgtttttcatatgttctctattgatggggtgtgtgtgtgtgtgtgtgtgtgtgtgtgtgtgtgtgttttccaggtgcaaaatcactgggccaattacccccctagcttccttgaagaagccattgtttttcttaattttgttaatttctggatacccaattttctttcttctacttttttcagtttattctgttgaaaaaattctaatttattgagttaacttcttaattcacacagattaacaaacatgagagagtagacattaagtccagaagttcactgttttagttgtatcccatcaggtctgatatgtattattttatacctatttgtattattttgtgttcttattttctagatattttgcaattttaatattggtttcctcttttacttgaaacttgcatgagataattttttgttattaatattctattacatttccaggtgctgggaaatatatatgctacacataaagtgtaaagaacgatcatcagaagaacactcttcaccagcagtttgagaaacaacattatccatatctctgaattccactttgctgcactcttctaattcatacatttctttaccccaagaaacacccatttttctgaatttggggttagtcattcaactgcttatatacataagcagtgataaacctccaatgaaaaatgaacgtttaagccttgatgtcaatggaatcatagtgaatgcattccgctctaatattcatttttctctgaacagtatgtgtggaattcatccattttgatactggtggctatagtttgctcactttcactgctgtgtagtagccccattgagcgtaaatatgacaatttacttctcattttttctatgatggtccatttagattgttatcaatttttagcttgtacaaacaaatttgctaggaatgttcttgggcataatccatgataaacatgggtttatttaggttagctcctccaggatggaatggctaaaatatacgatatattcatcttttgctttataataaaatgccaatgtttgcctgaagtggcttgaccaattgatcctgcatgtatcggcaccctcctgctccccatccttgctcatgtttgataatgtcacacttttaaacatttcttacatatgggatatgaagtcatatcacctagtacttttaatatctgtttctaagattttaatacaatttctcagttctttgtgatcatccaactttataaaatgcattttctttgttcacgcttttcttttcttttcaaatgcctttttaaaattgattcactgagattcatgatttactctagatacttatttgttgctggctttgtatgttgcaaatattttctgccagtgtgtggtttgtcttttcaattgatttgggggtgccttttgaagaagagaaattcaacgttttaacacatttgattaacattactatttgtataatctttaagaagactctacctcacagtcaaaaagtattctgtctatatttttctcttaatatgaaggtttaccttttataaataagacatttattcatcaaaaattgattctgtgcatagtgagtgataggatcccagcaatttttccaagtggaaaatcaattattctatcgctatgtaggattgttgtcataacaatttacaaaaccgttccacatatgtataggcctatttctgacttttcatcctgctctacttgtaaatccctgtactaacttcacattctcttaatttctgtaacttatagtatgacctcattaccgggagggcagcaatcttcatgattttctcttttggatatcctcttctgtaaaaatcagagaactctcttgtcaagttccactgggggttttatcttaattgccatcggatctatagattagcttgagaataatcaacatcttaaacacactgggtatttttatccaataatctatctctctatttaggtcacgtttaaaacttttcaatgcaattttataattttttttcataagaaccatggacaagtttgggcatggtggctcatgcctgtaatcccagcactctgggaggccgaggcaggcggatcacaaggtcaggagtttgagaccagcctggccaacatggtgaaaccccatctctactaaaattacaaaaattagtcaggtgtggtggcatgtgcccgtaatcccagttactcgggaggctgaggcaggagaattgcttgaactcaggagggtgtggttgcagtgagctgagactgggccactacactccagcctgagtgacagagcaagactccattaaaaacaaaaaacaaaaaacatggacgagtgttgttcagccctaggaagttatattttgctattatacttattatcatttttaatactttttctgtttgcagctggggtacagaaatgcaatgactttcttgaataagctttttattgaagtacaatagatcaaaaatgtgcacaagtcataagtgtacagttttttaaattttcaaacagcgtggtccatgtaaccagcacccagatcaagaatgaacacatctttgccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggagggggaatatcacactctggggactgttgtggggtggggggaggggggagggatagcattgggagatacacctaaggctagatgacgagttagtgggtgcagcacaccagcatggcacatgtatacatatgtaactaacctgcacagtgtgcacatgtaccctaaaacttaaagtataataaaaaaataaattaaaaaaaaaaagaatgaacacatcaccatgatatgagaaccatcttaaccagtgacttcccctcataaagataaccactatgttcatcccttttaccacatattagctgtccatcttttggacacttatggaatgacagagaatgtattcatttatgactagcttttcccccttgtttttgtgagatacatcatgttgaatatggctacagcttgttcattctctttgctgtataggtttatattacatgactagactataacttatgcacattaatgttggtagatttttaaacagtttacatttgggggatatggctagtatgaacattcatgggctcatctttttacatacttaggtgttcatgtctgctcatttgtacttagaagtagaattaatggttaagcatatacttagtttttgtagatcctgccatacgcttctggttttccaaagtggttgtaccaagattcacttgtagtagataagaattccaatacgaaatacagcctgtaatttgacattttaatatttcttattatagaaacattggcaaattctcatatgaattctaagattttatctacataataagctagcattctgagaatgaattcgccttagtcatcatgtttttctttgcataaacctggctcttgcaatttttttgctaataaattgctaactaactttggtttctgaatgtgcataagaaaataaagctataatttcctttctcatgctgtccttatctacttttggcacaaagtttatgtttactaagtataattaatcagagaaagtttcatttcttttttgtaagattttatgtaagattagaatttccttttcctcaaatgtttggtaaaacttgcctattaaatcatttgtacctgatgttttcattttggggagattgttgacagattataaagtaatcctttaaagattacaggactgctcagatttttttttcactaagttttaatatttttctacaattcactcatttcaggttaattctttagggtaattagcatagagattataatattatcttttacatcactgatgcatttataatcgtattttttcacatataatatggcttatttgtaccttctctctttttttcattttaccttggcagaggtttatcaattattttagcttttattatggaattaactttgactttgccaatctttctattgtacatatgcattccatttaattaatttctgtttctaccttaattatttcttcctttctgtgttctttgtttattctaactttgaagtgtgatgcatagtccattaattttcaactttacatctttgctaacataaacatttatggcttaaacttctccctaaatactgctttaactgcatttcacacattttgacatataatagtttcattatcattaagttctacatattttccaattttcactgtgatttctcctttgactccagagtaatttaggagagatttaagtccacacacagattttaaaataaagttactttttattgattttatgttaattataaacaaggaatgtagtctgtgtgataacagattgagttgaggattcattcctaacaaatggtcaatttttatgaattctcatgtatgcttggaatgaatatgtggtttctagtcattgaacactttgaaattgttcaaatcgtcatcctgatagtatatattctcctgattaaaatgttacttactgagagagaatatattaatattgcttataattataatgtatttgtcacattctccttgatgttctaacatttgctttgaatttttaaaggcatgttaatactgtcatactcagtttagaggtggttatatcttcaggatgaatttgacttttgtcggtatattaatggttatatttatctctggtaatgcaaactgtcattttaatagtgtttcctagtgtcccttttcctctaatttatctgtaacctttccatgattttatgttttaagttgtgactcctataaacagcataaaactggatttttttttaaatctaggagacaactttggtctcttctcagataattttgtatctttgttttagatatatttctaccaccctgttttgtgttttctattagattgctgtcaagattttactgtctggatttctttcatggtcacagttaacagaatttaggtattcctttttgtgttagtgatagtattttatttttcttgaaagttatccatttcacataaatttttaaatgcattagaatatggtaatcaatagtattctcctattttaaattgtgccatatctgtagactaactataattccccttaattctttgtgtgtgcgcacgtgcgtgagtatgtgtattgtctttcttccttttggctttgttgatcttctgggattttttctgttccattaatttttgttcttatgttaataatttccattattttactgtctttgaatctataaaatagtttctttttctggtttattagcttgaaaaactagcttaataattttcagccttttaaaaaataaggattaaagaaaataaatcttgctttcactataccctgtgttttaatgtacagtattttatttattttccctgaaattttattttgaggtaactgtagatgtacatgctgttgtgagaaataatatataaagctctcatgtaccctttatccagtttcccccattttaacatcttccaaaactatggtgcaatgtcctgatcgagttcttcatgtttatacagtcaagacacagaacatctccagcaccagaaggctccctcatgctgcccttcatagccacattcacttctttttgttccgcaactccttcttaacattggcagccactaatctgttctccagtttttttaaattattgtttcaagaatgttatataaatagaatcatacagcatgaaaccttttgggattagagttttccacttagcctaattctctgaagattcacccaggtttttgtatgtattcctttgtattgctgagtagtaatcaatggtgtgcaggtaccaatttgtttaactattcacccaagggacatctgtcttgtttctagttttgaggttgttacgtatgaaggtgcaatgaacactcacatgcaagcttctgcataaacactgcttacacaaaatatatagtagctttatttagagtaggcaagtagattttaatttattatgatgtctttgttgacccaggagtggttgtttggaattaaaaaattactaatctacatttaatagggctatatttttgttgttgacttatttcttctgtctttccagatagacagacagatatagatattgatgtgtgtttgtgtgtattcatgttttgaattaattgagtccttatttgatcaattttatgcatccatgtgtacttgggaagaatatgtattctgacgtccaaacatagaattctttaattttttaaagattttattaattttgttaaatcttttaactcctcattgtggtttatatgcttggtttacaaattactgagatgtgtaaaatctcccactatgatgtgtcatttgaaaatttttcctcctagtataatcaagttttatttcatatgttttaacctgctttatttggtacatacaaatttagaattattgtacctgactagtgaatttatcctttcatcacatagcttcattttttcataataattttttttgccttaagctctgttttgtctgatattattataactacaccaactctctttttgttagttttgcccagagtatcttattctattcaaaaatattgtatgaaacttctcaacttttttacttcctgtctttttgaatacttatattggcgatgtgtctcttaaggaacatgcagcttaaaaaatgaaataaaactttctattgtaaaatatagtataactatagaaaacagaataggacaaatatagagcttaatgaatatttatgaagcaaatagtctcgacatcagcactcaagtcaacaaatacaatttgctggccatcatggaatccccgtcccagtaacatacccttttcggcccctcaaagtaaccagtatcatgacttttataataacccctttcttcttttatttatagttttgtcttccaaatacacatccccaggcaccacggcttagatttttctgttttggttgtatatttttaaagacaatgccttcagtctcttctagtctatcagtcctgtctccagcctactactctccaattttcccagtgcaatttatttgttaaaatacagggtcattgcatctacatgcttactctaacttcatcttgtattttctctgccccagctctgagatgaactatttatctaaggatgcctagttccttttatgggagatggtatttagaaaccaagatctgcatgctagttgtgttcattgttactaggatatcattctttccagggcttgtcagcagacagagcttggaaagacatatatatatatatatatatgtatgtatgggtgtgtgtgtagatagatagatagatagatagatagatagatagatagatagatagtaactcatgcctaaacacaaacccatatctatttatctatctacctatcatctatctatccgtccacccaccaacctacatacatatgtgactatctgtctgtctgtctatctatctatcatctacctatctaatccatccatccatccatccacccacccacctacctatatacatacatacatatctctctctatgtgtatctacctatctaacctacctagtgacctacctacctacctacctactcacctgtctatccattctgatatttctgattccagttcaacaaatttcattcatgctttaccaagattttggccatttcatatgagttcaagataaaataccccttaagctcatataaaaacttacgatttaaatttaggactacaagttctcctatcttacaaatgtattgcctttcttcttcaccaagaatcctggttctcacggagataagggtaaaatagaaattagaatgtcatgctttctatgttgtacacctaacagtctcagaatgacagaagtaatttcaatactacgtccatttatttgattattaaaacaataaattgatttatagatccttttccaatattcctgcatctttaataggtgtgctgaatttatgttgtcagagcatatagccattcaatactgtacttttttccatagaatatttatttaatgttcaccagtagcctttatgctgatatctctctaatcatgttggttgactgaaactcattgagtagattattcaggaagaacccattagaacaatattatctgatttcctgcatgttgatagcaatttgcagtttttaatgcttgaaagtcagtcttgctgtatataaagtgcttggtttacatttttttacttgagtataataaatatatcactttattttattctggcacaaagcattgctgccaaaagactgataacattctggttttctttcctttttgtatgacttagtcgtttttcctggaagcatgaaagaattattttcttttgaggtccaaaaattttactaaaacatggctcagtgttggcaatccaggttggtgttctcaagtaggtatgaccgccctttcaataagtaattattgaagttatttcagaaaaagaaatagtacaacaagaactttttcttaaattttactttttgatatttgtgcctttgctttgggtttcttctttgggaattccagtataatgattttcttagcctgtcttgtaactttttccttttctcttggatctagttgcctcttgcttttgtaaaagtttccttctttaacttagttttctccaggcactagtggttgtgtgaatttattcgtgtgtgacttctaccttagtctccatttcttagatatattttcttaaatttataatttatttcctgagtcctatgactacattctgagttttctaattctgatttttgttgttgtgtctcatatcattttcttaatgtctttaacgctttctgaaatagttctcatctgactcgtaggcacatttatttggcaaactttgattttctggaggggtgttattctcctttttctttgagatggagtctcactcactctattgctcaggctggagagcagtggtgcgagttcagcttactgcaacctccgcctcccaggttcaagcaattctcctgcctcagcctcctgagtagctgggactataggtgtgtgccaccacacccagctaagtttttctactttttgtagagatggggtttcaccatgttggtcagtctggtctcaaaccctgacctcaaattatctgcccaccttggcctcccgaagtgctggtattacaggtatgagccaccatgcccggctttctttttcttgacactaactttgcatgtgtttttatttcgattatcttctgtcttcccatttatatgaaattggtttccctgagcatttagaagagaatatagtccaaaatttcatttctaaactcacagagctctcttttctcctgtatatggtatgcacgaatatggtggctcattttctgatactcgcagatcttcaatttcttgtcactgttgtctctgtgctactcaatttagatccttaatttcattgtttattcctggaagggaattttgactggttccttctgagagtccacagggcctagactactccagacacataaggtcttactgttgaccccttgtttttatcctctactgaaaattgcaagatccttcacagttttagctacaattctcaaatttgatgtttgagctttccaggaagtacctgttagttatgtgtgactctgaagcccatacgatgccttattactttcctctccttctccctgagtagtcctgacaccatgcagatcttgtagctgtcagtctcataataatttgatcgtctttccttgacaagtgatttagttttgccttgaatgaacacagaattcatttttcttttaaagtccagaaattttatttgaatgtctcattgttggacaacctgattgtcaatagtttgaccctctctactcattatttgtaatttatagggataacttgcctcctaggtgttttgtaaatattgttcatggggttttgttttgctgtttcagtttgtttgtgtgagggaatttggaaaatttaaaaactaagtcaccagtgtcattttccagccaattgcattttcttttctttcaacaacttaatctgacaatgtctcctttgattggtaagtttagtacaatgacgtagacatatattgtagttattgataagtttgatattagtttttcaacttattctatatttttacttcatgtttaaatttctaaacattttttaccctctctttaattccattttttccctctcctgtttcagaaattaatatatatatatctgcatcttttagttaaaattgtagccaggcacagtgacatgtgcctacagttctagctattcaggaggttgaggcaggaggatcacttgagctcaggagttgaaggctgtagtgtgctatgttcacacctgtgaatagtcactgcattctaacctgggcaaaatagggagaccctatctctaaaaaaaaaattgcacacatctcagttgaagtctaagtagtatcaatacatcacttccacagcaatccaaagatcttggaatacattaaatagaaactccctctcagtttacatgttatggttgaccaatagtttagttgtatcatgttttctacacacacatataccaacttgaactttactattttttatatagtcagtgtttatttagatttcccattctgcttaccaatttccttgctcaccactgatttttgcatagtaggcttttcttcctttctggggaaagagattgattttccctttcctcagctaaaatgctttgactttcctatgagattttattggcaatttactcttaggttttgtttattacaatacctttctcttacccatactatcaaccatgtatgcaatttaaggtttgtttctttccttctctcttcattttgcggatttttcgctgttttctggctttcattgctgctgttgagaaacctgctttgagttagtcattccatggcaagtgatctgtatacattttcagcctctttgaagacctttctgttgctatgaaatttcctgtaataaatctaagtgtcttttgattctttcttatttatcccgcttaggataaactggctttttgaaactgagaattggtgtctgtcatcagttctagaaagtacttggtcatctcactttgaatattgtcccttccttcagtttctacttacagaatacatatgtgagactctcatcccactaacatgtttctttattcccttcatgttttccttttttttctctctctctcttcttggctacaatgagggtattaagttctagcctccaaccaattcattaattctcttctcctgtatgtctcatttccttcataatatgtctgctgagtttgtcatttcctatctaaattatatttgattcttttaaaaatatgcctcctcaacatttggtgttctcaatccattatcccattattcatgcattttgagacagggttttgctctgttccctggagtgcagtggtaagattactgatcaccgcagcctgtacctcccgggcccaagctattcttccacctcagcctcccgctgggactatatgagcacaccaccacagctggctaattttttaatttttatttttgtagagaggaggtctccctatgttgcccaggctggtctccagcctgaattcaagtgatcttcctgcctcagcctcccgaagtgctaggattacaggtgtaagtcattgttcccggctcatcttttatttctgtaaatgttttaaatattttttccatatttggtcattcactgagggtatatgatttcaagtacataagctttattcagggtggagcctttgttctaactccccttaataaaactgaaactcaaggttctttttattgagaaattttcctagggcaggcagtgctgtatattcacttacaactctattctcagctctcttttcacttttgtcccctggatatttcccttaatttcacaagcatagtcattcacttaaaaacacacactcgtcctctcccaacatatacgtaattgttacagaaggatttttttaggatacacggttttcaatattggccatagtgaaagtaagttgggtaatttccacatttccatttccctaattatctcttcaaatttctctgattacctcttcgagtctctataatatgaagagttgtgatttttatgaatgtagaagctacagcaaaaagactaggcagagaacacggaatctatctgttgttggctagagtttatcttctaataatttaacaataaacattaatggggaccatattcctgaaattgtgtgtttatattgtccatctcctgtacttatatgtgaatggcaattttgctggttgcagattttcagggtcaaactttatttctctgaaatatttacagatattattctactgtcatttagcatttaatgttactatggagagtgtttttttttttaattttgtaggccattgatatgtttgcttgtacaccaaataattctttgtttagatttaaagtccattaattttacttgatatatccttgttttgaatattctaaagagtgtttccccagaacacaatgtgatatttccttctttaggtttaagactctcttaatttctgcagcaaattcttgtgttctatctggattttttctcttatcattcttcagtgttttctttggggccaccacatatgtgtatgttagactcctttgtcttccatgtttatcattttctctctaatgctttctaacgttttactgatttccatttccttttcctcattgttgttcatgcctttaatgttttcagaagtgctcattcttctttgtgatgcttccaatatggcccctttgtttctgtgatgactttattttgctattctacttcactcctaatggaagcaagatcatactttatcctctgcttgatacttctctgtgacatatttttggtagaaaagataattgcttaattttcttttaaaattagtagtgataaatttggtcccagtttttatctgtgacaacactttctggcaagtgttctttttttaacttgtctttttcctatgcttttccatgattgtattataagtttttgtgtagaatctgttctggtatctctaaaataactgttattaccaatctctgattgagttgagtcctacttgaatcagctatttgtagaaggttttatttgacgtggagcagggccaagttctaagatagcagaaattctctccagtttatagtaacattccttatggtacatagcattggttgtgtacattgcttattttagccagcaaagattaatgtcataggattaagtctcttctactctaccgttctaagagactgacttcttggttcttttttctttttttttttttttttttttttttgagatggagtctcgctctgccgcccaggctggagtgcagtggcacgatctcagctcactgcaagctcctcctcccgggttcacgccattctcctgcctcagcctcccaagtgactgggactacaggcgcctgccactatgtccagctaattttttgtatttttagtagagacggggtttcaccgtgttagccaggatggtctctatctcctgacctcgtgatccgcctgcctcggcctcccaaagtgctgggattacaggtgtgagccaccgtgcccggccgacttcttggttctttattcagtgtttccttccttgattctccatggtgccaaactgtacccaggaattgtcccatcctatgtgctttatccctgaaattgacatcgaagggattattggcttatggtacactgtcagtcttgcagatatgctgactttgtttaaggtctgcagccacagatgtcatctctcagcatctgaccacacccttaatgtacacactgcaacctgccacctttcctcatcattattttccaacataatatattcttcctagttttaccacagcacttgcatttccttttctgatttttcttcttatggagaaggggaaaaaaagcagaaggagcagaagggtctttgctatctcaaaatcagaagtctgttcctcacctttcttaacaacctttgatatggaaaaatgttggaggcttttcacaagcctaagtagattgtaggctgtccctgaaaatgtcatttgtaattaggttgtctggaatttggaatgaattttcttataggaaccaagttgtaagtggtatttggcaaccaagaccagctttccaataggcagtttagctggatgcattgtgttaatagcattattctggctccatagaactaccatttattaagttatttctaaggaaaaaataaattccaagttctagttagtagaatatagaatcttttaaaatgcaaaactatgccactctcttgtttaaaatccttcaacagttttccactgttcataggccaaggatgaaatcctcagcatggcctcataggcccatgatctggctcctgtcggcccttctaaatttgaaccattttccaaactggccttcttattgttcctggaacatgttatgcttcttccagctctcgggtgtttgcatatttagttccttctgcctagaagatctttctctcacattttgccttttcatgcttacccacccttcagaactcagctcaaatttcatttatttgggtagctttcacaggccgaacagccctgccatataccatctaatagcaccagatttccctgtctttatgtccactttatgtctttatgtcccaatactgctcacagtgtctggcgtatactagatgttcaataagtatgtgtggttagatgaatggataaatgaatatccattcattatccattcatctaataaatggataatgaatggataaatgaatagttcaatatttcatgttaaagacaaagctcttaatttcaaacctacttttctgaagttaaggaaatgtttgtcccccttccactcctgatgccctgcctggaatatcttgggtctgggtctctgatgaatcatgtgtatgttacatacaattccaagtgtcagcctcaggataaccaatgctataagtagtccttacgacaattaagggcaaactctgaaaaaagttactaaaaacggttcattatctgaatcctcacagtgttacagcttaaatccctgaaatataaatactaagacataaaatcaattgcattttatgcttgcttaatcttagatatctctatctcaaaacattccaggactgtggccatatatcctggatttttccgggatagtttcatttttaaaatagattaagcctttgctgctagaaagtgcatctcacctgtcagactttgtgtcctgactttttgttcatacaactcgctctctatgaccgtgtcaactatcagtttgtcacaagtatctttttgaaccattgtatgcttcctgcgagaactagctcttgtgaaaagttggagaattttaaaacctcaatatgaaacagaaacgaccttttaaattttaaattaacgtgctcaagtttcactacataaccctgattcagcttcctcacctataagatgtcacgcatggtgcataggacttcgaagatcctcaaaaatggtgtagggaatataatttctgagttcaaaaagatgttagtttaaaaatccgcttggtaaaggtaataaaaggtatctgaggtttaaaagtcccagtgaatagtacggggaagggcaccgtgagaccacgactgtctaatgagccgggtttgacacatgtgaaacaaggatgaccttgttggatcatcagatatggatggaagaatgggagaaggaggagccaactgctgataacaggtatcatcaagtctgaaaacactctctaggcgccttgcacaaagtcaattttattttatttttttggagatggagtctcactctgctgccccggctggagtacactggcatgatctcagctcacggcaacttccacctcccaggttcaagcgattctcctgccccagcctcccgagtagctgagactacaagcatgtgccaccatgcccggctaatttttcgtatttttagtagagatgaggtttttccagttggccaggctggtctcgaacttctgaccttaggtgatccactgtcctcagtctcccaaagtgctgggattacaggggtgagccactacgcctggcctcaaagtaaattttaaaatatcaaaagacctaactcttattcctgtgcaacttgttagaggaaaaaaaaaaaaaaaaaagaaaaaaaagacttgatggttttgtcctttgggcatacaactgcctttttattgaaacattactacctgagccaatggaaattgatttatttaactcatcgccttctcccaccatctccctgctttcttgtctcgccgtttctttacctgaaagagcacagcaaggctttttgttacattgggttgtgttgatcctggatgagtttataagactgtggacttgctccttgcttctagctattagttgatttcatctatcttgagaaaagagaaggcttgtacataggccgatgaggtagtttccacagattcactgagaaattagaagtggttcactgtagcaagccctgaggcatatctctgaaaggagcccagcctttaaagatcaccttctttcacagaaagtgggtccaaccaagcactcctaccaaccctctctaagtcacccagcgattcattgctcagtcactgcatgcccgctgcatgccaggcaccatgcaatgtggctcctatccataaggagtgtggatcctggtggcagagacagacacagataatcacaacataatgtgttaagtgttgggggaggtataaactgctgcgtgagcattgaatctaaaacagttagcttagcctgaagacaccgtggaaggctttgaagaggaagtggcttttgggatcaggcttatgggaagaagagttaatcagatccatgtgggaaaaggaaattcaacctctgagtaccacgttttcttgttctcttctttatgtttttgaacttgcatgtgcttctcctgtggaccaaggcttctttctgatccggtggtttgtcccaccatcatcaccccaggctgtcacttgaggaaaaaggtaaagggaatagagcggggagattcaggcatccagctttgcagtacttgtgcatccaggagccctacttctgacttggtggggtgggatagtggccaagtatttgctttttcaactagaacctgggataaattggatgtcagtggtttccggagaaacatggcccagcaccttccctgtgacacagtgcccagcacagtgttccacaccttgaacccaatacaaaacacaggaaatgcttaacagagaagcaaacgacatcatccttagaactaaaatttccaaatgtaactcctactgccacctgttggtggtatggagatgtgacccacctgcggtttggaagctatctttctttgtaatcctgtcaagttggcaacttaaaacctgaaatttccggagttaatatatactgaagtgccaatggtggttttcttcaggggtactcttttttattatgggctgtgaagttctgaaatgttttgcaatgagttactattttgcaatgagtctatctccttttctattcagaagaacagagtaaagataagagaaaattaaaaatttacctatggggtagacaaagagcaatctacttagttaaaaggggttatgaacaggcaaaagggcatcaccagaaattgagaaagaaaggaggtttctataaattgattaccttcttattaattatcatttttacttggggatggcagatatgcccgactcactggtgctggttaggcgaggccttaatcaaatcgtcaacagccattctcaggcactcatttagcaaattcatactgaatgcctcctggctgccaggcgcccttggctgcagcctccaacagtttcattttggggtatagccaaccttgagaacaagtggctgtcagtggaattcagactatggataaatgctgaagaataacgccacgtgcaagcaaccaagtacaggagcaaggactcccagtgctccgggaagtacctgtccctctaaagagacagtcactactttggatagatgttggctgtcctccacaggcttacagatgcagcttcacagcacatgagagatagaggaaaccgcagacctcagcagggaggccagccctctcattttactgcaagggaaacatatacagaaaagggaagggactcagccaagcatgttttatttgagaagccgtgctattgtctgtctgctggagctgggaagatgagcgtgccctcatgggagcctggtgggatagacagatgcttaaactaacaatgtcactgtagtgtagtcagtggccgtaacttgggctggggataggcaaggctatggggacgagaggaggcagtgctgtgggaccctttgtctctctcgtgcttggggatgaagaacaacagagctttctggatacagacccttggaagaagtgtgtggcttagggcacaaggtcagctgccatgggtccatgggttcaagtcccaagttcattaggttctttgagcctcagcttccatctctgaagtccccaccccatagggctgtttgtgaggctgatataaggaatgcacaagtgcttagcacaaagtgggatgtcagtgcatggcatgattctagaagtcctccagcaatccattcacatccttctataaaagggctatatccagctatggccagttccatctttttttgagacagggtctcaaatccattacccaggctggagtgcagtggcatgatcatagttcactgcagtcttgacctcctgggctcaagcaatcctcctgcctaagcctcccaagtagctggggccacaggtgtgcaccaccatgacttgttaacttttaaagaaaatgttttggtaaagatagtgtcttgctgtgttgcccaggttagtctcaaattcctggtcttgtgtagtacttccaccttggcagttccaccttaaataactaaagaggccctgaggaagtgcatttgcttctttgtgtcacaaccatatccttagacctgaaaccattcccccaacatctctcccacgaccctgggaggtgcttaggcttgaccagtcatgggctccaggtataaacccagtcctttcaatacagacattttcttcccaaagcagacctacagctcacgagggagaggcccacagtctacacccccaataaagatgccccactgagccccagagctagttatgcaagtcgtttagcagagcctctcaaatccccactcttaatgcagggagagttatgggagccccagcagcgccttttaatgcaactggattaattgcctgctcggaaaacagctcgattctaaatgatcctaaatggcctctaatacctgtaatcttccctccgccaggttgccctgctgcattactaaagcgggactggttctggaagcccatttgcttagtaaacagcgggcagcattgcaggaggccaaaggctgagaaattgatgaaatcgctactggcctattcaccagcctaatttgattctagaaaatcaagcagaggcatttggactggactgttccacaagctcagtgttcctttgcaggactgggtaatcaaatgcgggtgtgccgccgggtctcaactctggtccttcccagcccggcagtgagccgtctctctcaggaatcttgatcttctttctgaagaccacagatggagctgacaaggaaccatgatgtctttcagtcaatcaattacctggaaaccaggagtaggtgggggatggcacacaatgggcagtgtgttctcgctttgggtttgcacttatctggtaaacaggtgagcaccacaattaagagaaaaaactcaagttggtgttttagctctgccattactagctatgtaactttgggcaagtaacctctaggtgcctcagtttcctcatctctaaaatagggatgattacaatagtacctacctcaaagggtgacagtgagaattaaatgccttaataaatacaagatgccttgaggtctggctaacagtcaattctataaacgcatttgctgtcatcgcagcttcactgcttccatatgggcaggcacatgccctccctcagcctcagtccctacttctgtaaattgggtcaatggttgttgtgcaagggaatgggggtgaagggtgcataaagtgtggcattgaggtgtccagtaagcaggcttcctctcctgccattctcatacacgctaccactctggaatgcttcttctctgcagctgccctctctctgtccagatggacagtttccatagagatccatgtgaacactgaaggaagacaggtcacctggccagggaggcaggtcgggagaaggtgagccagacccacttggaaaacaaaagatgagcagacaggtgtctgcattttcttcctgtagaccagtgagggtgagggaaagaaatcagacaggctgtgttcacttgaaatatccggcatttgagcctgacattgccttcattgggagctttcaccaaaccagtgtccaacagtgagaacgcttttgaatccttggcaaacagataccagcagacagtgtgtgtggatttccacaaggacagcatcttgcatgacaaagacatcaagatacaaaactaggctgggcatggtggctcatgcctgtaatcccagcactttgggaggccgaggcgggtggatcatgaggtcaagagatcgagatcatcctggctaacatggtgaaaccccgtctctactaaaaataccaaaaaaatttagccgggcatggtggcgagcgcctgtagtcccagctactcaggaggctgaggcaggagaatggtgtgaacccgggaggcagagcttgcagtgagccgagatcacgccactgcactccagcctgggcgacagagcgagactccatctcaaaaaagaaaaaaagatacaaaactagagtgctacagaccgcagccaaacaacactggccatatcttaatcaacattatcatgagtgactctggtgccaaaagccatgtttgtcctcactctgcagtctggatgcctatttatctactgactggctgccacttgatcactctgctcgattgctccctctgtaaaatggggccaactatcaacctacaacataaggtgactgtgggaataaaagcagcatatcaacaatggtacgtatttgttgagctctcagaatgcacccagtgctgcgctaaatgtttaatgtatgaattctaacccactgactcttcccactcgccacggaaagtgagccctgctgttaatccctattatgcggataagaaacagagggaaaaggaggttaatgaacctgcctgaagtcatatatagctagtaaataaggcgctgttaccaaagtccctggcacaaaataagtactcaacaaaaatatgcagacacacaaaaaaaatgagatcatgtcctttgcagcaacatgaatagagctggaggccattatcctaagtgaaccaacacaggatagaaaactgaataatgcatgttatcaactataagtggagctaaatgatgagtacatagggacacaaagaaaggaacagcagacactggggagtacttgagggtagagggagggaggagggtgaggatcaaagactatcttatagggtcctacgcttattacctgggtggtaaaataatctgtacaccaaccctgtaatatgcagtttacctatatagcacaccttcccatctaccccagagcctataaaataaaagttaaaatacatatgatgtaagttggtagagccacttaggagaaaaatttggcaagacctatatctaaagcattacttctagacagctagctatccaagaacatttttgcaatggctaaatagagctattgtgggggctaccatcagtgctaacttttggggaataaaagggcctcatggcctcagggaggcaccagattagttaagagtgaatggttgatgggaccaagtaatgcctgagaatggccctgcagtgatagggccctgtataaagaggttgagtgcacttatctggggtccctgtggcagggcaaagtttgaagcgggcttggttcaggcagggtttggagttgcagatccatagcctattccatggccattggggtggccagatcaggggcaacacaaagattgcaggtactgccagaagtcactttctcatcctgagttcagtgacctcatctataaactgcatatacagataactaccctgtctattaataggaagcttatgaggactcaataagatcggctagtctggttattcctcaccatccctcagggaagaaagaataatctcctgcactaggtttaaagcagaaacgaatgctgcaccaagcagaagcctcagagctctgccagggacagaaacttgagtgtccctgccccggcagagctctgttttaaccatttcataagcaacagcttcccatgtgccaggaagactttattttttcaattcaaaagagcacctaacatttctcgaaagctgcctatgccctatacattatctcctttaatccttacagtaacaccatgagagaaatttccttctgattttatagaagtcataactgatattcccaagaaattaaatgatgtacccattggcagatggctgacaatttggaaactctacatttgcacctaagactatctaccaccaattttcttattaatgatttttattctacctgcagtccctaatacttctttactctaccgtagcacatttgtcaggagatacctgcattcctgtgtgtgaacattttaccattattcactttatgggctatgggaatgtcatgactgttctgggccactgattacacatctctaaaatgaagacagtaacagtttactcattggattgtctcaagattaaataaggacatacataaagtgtttatcagaacacatgagaagatgttcaacttctgtattaattaggaagatgagatgccatttttggctcattagactggcagaaatgaaaactttttttgtaatattaagtgtcaaaaaagatagaggaaatagacactcttctatcactggcagaaaccagagatttaagttggtagagccactgaggagatcaatttggcaagacctatatctaaagcactacttctagatagacagctatcaagagcatttttttgcaattgctaaatattataaccaacctaaatgtctattgatgaactaatgactgaataaccatgatatatctcttgtgtgaaagataatatcatgtaataaaaagaattgggtaaatatgtagtaactaagttgaaaatttctctaagaagtagagacaagtggaaaaaaaaaaccctaagttttagaatattatcaaatgtcacttaggtcaaagaaaaaactcgaaaatgacaataggttttacagatatatatacgtgttggaagtgcattggatgaagcctgcaaatatatacattacactggtaagagcagtattctggaatggtggagaacagccacgagtttaaatggacatagtattacctgatgttataaattttacaaagtgaatatattcatatatgatttgtacacttataaaggtaaaataataacaataaatgcagttataatctgtcaggtgttgactctgaatcttcattttctttcaaataaaattattcatttagaaaacaaacttattgtgtgtctactctgatttactttcatatgacatctttcaacagaattttttcactgaaagggaaattatgtttttattttgctgatgatgaaagtgaggtttggcttaagtgacttgctcagttagtaaggcacagagccaggattgaaaaccagctgtttgcctccaagttcagttctctttcaattaatccagcaagtctttactgagcactgtgtatgtcccaagctccatactaggtattggggatgcaacaggagacaggatagacgtgctccctgttttcatggcatcacggtccagcgagaaaagcagacagagcaacatgtacttacaatgcagtgtgcagtgcttagatttcacgggtaatggcttattcttcactgacgtctgaaacaaagtatggacgcacaactaaacaactagtttaggtctgattcatcagcataaggtataccaccaatgtatcctgctgctccaaatatgttgattctctaatagatctctgaatcaatagtaataatgaagatagttattgagtattaactatgtgtcagatatcattccaacatttaaatataacagatgacacatttaattctcataatatccctattaagtaagttctattacaatctttatcttacagatgtggaaaggtgaggcacagagattataaaaaagaaaaaaaaaacaaaacaaatacacatctgcttaaggctatgcagctagtaaatgctagaaccaggattcaactcagggctgtctaccttgcaaccctactctacactgccttcccaacaaaaggttccaagctgctcagcaggacacccctctcaaggttccttttccaagtcttctctgaaatccgaacatactaatagagtatcagatgtcatccttgtacaagaatcaggagtaggtaaagagagagagaacaggtggggtctttgggctaaatctcatgtcccctgttggaagaaattaataggtcctagaaagagggaacttatttttcagtaaacacaagcatgtaaaagcatcttgacctcagccccctaatcagaggagcatcttgctaattgccactaatgtgattagcagaattaattggccgctcagaaatattacacatcaagtcacatggcgattaatctataccaaaattgggaacatcattgctcagtacagagacagtgagacaactgacctccaaagggaatcctgatgctctcatacattcctcttatgcatcgtgagtatgttgtgcattagacaaaggcagggagatctttctaaccactcacggaggctgcttcactaatagtaatctgccacttccagtccagctagaacttcttcctgcccactctccacattggacacattcatactcccactcatttctccatgttgtttgtgcactgtaatgtatcctcctgaatctttgttgcattttggcaaactcctattcattttccaacaagaggttcaaatgtcaccaatccatgcaactatcactaattctccccctcaggtatttcacattgatttatgtacaaactcctatttcactagcactgttggaccaccgtgtgtacacctaccagtctcttccattggcaatgggacctcagagtcagggatcatgttgttcttaatactggatcttcagagcctaagtacagatcttggtattcagtaagactcagtagttgctgaatagttgactctgtatctccagactaggcgtggggctgagtacacactaactgtggttcctaggcttgagggtatagacttaggaaatatgcagattgaatcaccagggaattatgtgaaaataaccctgttgctcctaccatgtgtttctgatcttggtgaattacaaaagtggaggatcaccatcactttttttttttttttttgtggtaatcgcagggttgggcctggttagtacttgaatgggaaaccatcactttcttgatctctcattgcttaaataaatgatcaatttatcaatgtccttaattgtgatctaatctgccctctccccactagacttgtcttagtctaggtttcacatttctcatcagacacagatacctggagaaagcatcaaacatgaaagatagagatcaaaacaaacaagcagaacaaagcaatttggagggacttgttgacaactaaaaaaaaaacccacatgcatttaaaaaaaaaaacaaactattactaacatccccagagagataacagaccatattgcaaaactgtgaacaaaatattagaaaccaaggaacattcagaaaacaataaaaagctcttggaaattaaaaataggacactatatattagaagccaataaaagggttagaggatgaagctgaggaaatctcttgaaaggcagagcaaaacatccgaagatttggacaataacaaaagtgtgggtattacagaaccaatccaacagttccaacatccaaatactaaagttccagaaaaagaaagcagagaaaatgaagggagagaataaccaacaaaacaggtcaacaaaattccctagatgtgaagaatgagtatttccagagtgaaacagcccaccatgtgctcaaccaaataaatggataaaaattaatccacattaaggtagataatggagcaattttataatgatgagacactgatcatgtcatacaagtttggacagggaattgggaaaaattcatacttaggaatcagaatggctttagctttctcaaaagtcacactggatgctgggatgtaatagaacagcaccttcaaagtagtaaaggaaagttatttccagtcaaattcttccctgagtgtgagagtcaatgacggaaggtcttcacatgctgacctgctgtgaacactttcttaggaagctactaaagaaagtgcacctccaagacaaggcaggaaaaaaagaaaaaaaagaagtgaggatggagttattggcaataggagcaggaatacagcaggagtaaagcataatacccttcttgaaggtagagtgaaagtggaggaagatcccagaggacggcacagagagagcacaacaccagcacagagcaagccagcagctctgggagagctttctgtaggaggatgaaattgaaaaaataactgaagcatctgaatatcttgagtagagctttagataattggcaaagtgttggggctgaattagtaataaaaacataaaaatgaagcaaacaaaccataaacaagtcaaatattagcttcagggaaaacataatagttgtgcaggaagggaaaataatcataatttactgcatggttcagttttgaatagcatttacatagtcaaaatagtgtaaacattgaatgttgatctagccaaaattaggatataacttcatcgggaggatggggaaggtaggtggaagggatgcctgtatgagtgatgggtggggagtacagggaaagcaaaaccattaatagataatggtacagtggaaaagtcacaagtaccaataaaggtagctaattcagaaatatgttttgcataattataaccaggtgaaaagtgtttgcaactgggtgagagaagttggagtctacacttgctcctatcatatgccaaagaacaatttgatgatttaaactatgcgcacatagaacttggatagatttttaaaaatataaaaaaatatacaatgtgatgtcaacaccccataggttaattccaatttaatgtgatgccaataaaaacaccaacaagataattctaaattttatgtgaaaaatgaacaaccaacaatattagacaactgaaaatgatgagcattacatggggtgaaggtgggtgttgggggtagattagctatctatgatattcaagcatactttacatttcagtaaataaaactgtataattccagtatgctagtagacaaaggaatacagtcaaaacttagaagtagacaaaattacagcatggatttaggatataataaaggtggaatataaatcagtaggaaaagagatacactagtatctagtactagtgtactagtaaatagtaaataagtatttactagtaaatactaatactagtaaataagtatttactagtaaatactaatactagtaaataaagctgagtagccatataggaaaaaaaatgcagctggaactatagctcacacaaaggtaaactttagatggagcaaataatcaaaagtttaatggaaaagatgaacctataaaaataacaagagaggctactatttatttatacacttggagagaaggaagcccagtgtgatacaaaacccataaaaggaaagatggataacatatattgaattaaaattttaaaattttaaaaaattttaaatttaaaattaaaattttaaaaaaatctgtgtggctaaaattactgtaaaactaagtgatacggtttggctgtgtccccacccaaatctcctcttgaattatagctcccataatccccatgtgtcatgggacggacctgatgggaaaaaattgaatcatgggggtaggtttttcccatgctgttctcgtaattgtgaataagtctcacaagatctgatggttttataaaggggcagttcccctgcacatgctctcttgcctgccacaaggtaagttgtgtctttgctcttcctctgccatgattgtgaggtctcccaagccatgtggaactgtaagtaaattaagcctctttcctttataaattacccagtcttgggtaggtctttattagcagcataagaacagactaattaatatactatgtcaaaaactttaaactgaaaaaagcataactcatagttttcctaatatagaaagaagtactacaaatcagtcaataaaaaacaaaccttatttattaataagccaacagaaaaactggcacaggagatagtttccagggggaaaaaaaatacaaatgactcataaacatttgaaaagatggtcaaattccagacacataaaatgaaattttactgagatacaatttttcacattttagacaggacaagttaaaaatgtatactttgttgtgaggatgtagaggaaacaagcactgttatgtaattctgtaagagctgagacgtgacacaatctatgtagagaagataattgaacaaatctatggaaattacatctgcaattaccttaggacaaagaattctacttctaagaatttttcctactaatatactcacacatgcatgaaataatgtttataagaacaaatgactgcaaactacttatatatctattagcaggggactgttaaatccaccaagtttcattcatatcatgaaatcatagccattttaaaaagctctttatgtaatcaagtgacttccaagatatattgagcagtgactaaaagaaggtactgaacaagaggtctataaaagttatgtgtacactatagtctattaagtgttcaacagaattatgtctaaaatacatgaacattacttactgaaaaatactttgttgctgaaaaatgctaaggatcatctgagccttcagcaagttgtaatctttttgttggtggagggtcttgtctcgatgttgatggctgctgactgatcagcgtgctggttgctgaatgttggagtggctgtggcagtttttaaaaataaaacaacagtgaagtttgcagtatcaatggactcttcctttcacagaagattactctgcagcatgagatgctctttgattgacagccttttacccaaatgtagaacttctttcaaaattagaatcaatcctcttaaaccatgccactactttatcaagtaactttatataattttctaaatcctttgttgtcattttaccagtgtttacagcatcttcatcaataaaagattccatctcaagaaaccactttctttgcttgtccataagaagcaattcctcatttgttaaaattttatcatgagattgcatcaattcagctatatcttcaggcttcatatctaattctatttattttgctatttccaccacatgtggaacgacttcttccattgaagtcttgaacccctcgaagtcatctgtgagggttagaatcaacttctcccacactcctgttattattaatatcttgacattctcatgaatcatgaatgtccttaatggcatctagaatggcgaatcctttcctgaaggtttcccatttattttgcccatatccatcagaggaatcaatatctatggcagctgtagccttacaaaatgtatttcttaaacaagacccaaaagtcaaaatgacttcttgatccatggtctgtagaatggatattgtgttagcaggcatgaaaacaacgttaatctttttgtacatctccattagagctcttgaattaccatgtacattgtccatgggcagtaatatttagaaataaatcttttatttctgaggagttggtctcaatagtgggcttaaaatcttcagtaaaccctgctgtaaacaaatgtgctgtcatccaggctttgttgttccatttacagagcacaggcagggtagatttagcgtagtgtttaagagtcccaggatttttggaatggtaaataagcacagtcttcaactcaagagtcaccagttgcattaccccctcactagagagcaagtctgtccattgaggctttgaagccagacatttgtttctctctagctacgaaagtcctagatggcatcttcttccaacttaagacttttgtctacactaaaaatcatctgtttagtctagccaccttcatcaattatcttagctacacatgctgaataacttgctacagcttctgcataagcattggctgcttcaccttacacttctgttatgaagaaaacttatttccttaaacctgatgagccaagctctgctggctctaaaattttcttctgctacttcctcacctctctcagcctttatggaattgaagagagttaggaccttgctttggattaggctttggcttaagggaatgctgcggctggtttgatcttctgtctagaccactcaaactctctatgtatcagcaatatgactgtttcactcctgttgtctggagcatatcacagatatgtaagaaaacccactgtatgccagactttgggtagaggggacatttattgtctcagcacttgggagactttccactcctctctcaggagagagcacagagagtagcctggctgtttatgtgagaatgcaggcaccaaaagcctagtaagcaagtaagatcacatggtcttgcattcaagtcttgtgtaagctatacattcctgagcttttaagaataacagacatgggtcttctttttttatttaaaaacatttttattcttaagagagacaaggtctcattatgttgcccaggctggtctcgaacttctgagctctagtgatcctcctgcctcaacctgccaaagtgctaggctactggtgtgagccactgtgtctgacccagacatgggtcttctatggctgtacactccccagcttcgcctttagatccaaggcctgggcagaaaactagcagtgctgtgaaggaacatacggccagacaccaagccaagtgcctcagggctctgttttccttcctggcttgcccatgcacatttaacttctgccacttcagacctgcctggatcctcagaccaggccccgttaaggtcatacccttatctatccacctgtgctggcaaagtaaactctgctggacttttaccttggaattccgtagtaccggtcaagccacacaccttttcccatgcttcttatatgtgtgaaacaattctcagttacctggcaaacaggagtttttaatccaggggttcatcaaaccaccctagtaggattctgcaagtccagctagaagcagccagagccagctgacagcagtgtgtgcagccctccacacaaacggccatttgcctgccaccaaaagccactttttgcactcaatgcacacccactatggcgagattctttttttcccaggtaccattttgctcaacccacactttcaattccccagcctatcctgaggaaacaaacctaggctttactcccctacccagaaagagtcttctcttcctactcaaactgaaacacaatgatttatatccacatcacatgtttaataaaagagaaccaatcttgattgaaaatcttttgagaagtggtcagcactctcacaattggttgaaggcacttgggctgggtctggttaaatctctattctgggtttgaccctagggcaggtcacatggagctggcaatgaaagactcccataggctgttaggccatcttcactcacagaagttagcaacaaggtccacaagaatagcaacaagttaggagaaattaaatgcatctgtatgtttctaagtgtgtgtcttcatttcctgttttagatattgtttatatctcagatagacatttatatgtatatgtgtttttttctatattagtttaaatatctatatctataaatagttatacataatatttcttatatctctttcaatacatacaaatacatgtatacataggtaaacattcctggtgtatttgtgtgctcattatagtagcacttttaattttcttcaagaactttccatttgcactgataaaagaaaatcttcagccaaattaaatttaaaggtgtttaattgagcaatgaacgattcacaaatcgggcaaaccccagaattacagcagattcacagagactccagcgcagccacgtggtggaagaagatttatacacaaaaaaggggggaaataatgtacagaaattgaaggtgaggtacagaatggctggattggttacagcttggcgtatgcattatttgaacacagtttgaacactcagcagtgtatgattggttgaagtacggccactgggattggccaagacttagctattgttacagctgcatactactagttaggttttcaattctaacaaacaacagacaaaaaaagaaaaaaaaaacaagaaagaaagagaaagaaatacggagtccttctcaggccatatttaatttcctttaacagtgtttccaacttaactaactgctttgtgtaagaggtccagcttggtgcctgtctgtcttggctttcagcatgccttcctcactaagcttaatcacgtctagctttggatttaaagtgagagacctgtgactcttcctttcacttgaacacttagaagccatcgtagggtaattaattggcctaatttcaatatttttttgtttcggggaatatgggggcccaggagagggagaatgacaggagaatggatggtcagtggacagtcagaacacatacaacatttacccactatgtttgctcattgctagaaaggcaacgtttgtgcatccccaaacaattacaacatcaaagatcacttattacatatcactgtcatagatctaatagtaatgaaaacgtttgaaatattaagagaattactgaaacgtaacacagagacataaagttagcacatgctgttaaaaaaaatagtgccttatagacttgcttgattcagggttgccacaaaccttcaatttgtaaaaacatacaatatctataaagctcaataaagcaaagtacaataaaatgaggtatgcctgtgtacgcttttgtgtgttttgaattttgagcctcagaactctaacacttatttagaaaattacatgttacattagcaaaaatcttgtaaaaatgctacctaagaagctctacagtaagtgaaaagttcagaaaagtggaaacttgctaacatggacaccaagaaatactaaaattattttctatatccttgtaagttatctctttccttaattagtctgagtgacataaactttctatatgtatatgtgatagaaacactgtaaaatgaaaaaaaaatatattatttagagactttatagtcacagaagggaatagatgcattattttcaaatgaggaaatatttttattaatagaaaagcaagtcgagtcttagaataaaaatcacatcattaattgacagataaaagactgataaagttcaacctctacttttgattaaatctttcagcaaactaagaataaaagataacattcttaacttgttaaaggttatacctaaaacctatagtaaatagtatacatttttgagaaactgtagaaatattccctttaatattaaagaaaacacaaaggtccctatatcccaggttctgcttatcaaagaaagagaaaaggatcagaatgaggtgtaaatattagaaaggaagacatataattgtcattatttgcagataatacaatcatatatacagagaatgccacacagtcaacaaactattagaatcaataagttttactaggtagctagatataatatcaactccagaaaatcaatagcatttttctacaccatcaataagtaactaaaaaacacagttaaaaaagataccatatactatgataacaaaaactataatatgtttaagaatcaacaatcaagaactcctaagacctatatgaagacaactttttaaaaaatctgataaggtaatggacatgaaaaaactcaacaaatccaggcattctatgatcttggataggatacaatgatataacaaatgtgctatattattattaaattaatttacaaactcaatgcaatcttgtaaaaattctaattggactcctataagaactagataaacttagcttaaaatttataagaaagaataacaatccatgactagctaagatgaaggatggtgacttgcccaatccaatactgaaacagaacaaaaggcacagtaatagtggaattgaataatgagctctgagaaaggccaatgaaaatataaaaatatatcatgtaataaatgttaaattgcacatcaataaaaaagtgatggacagatttgtagatatgttggaaatactggatcaccctatggaaaaaaataaaacatgcaaagatagatttcaaatggatcaaataacaaaacataaaaactgaaactataaagttattaagagaaaatatagaagactatacttgtgacttaagggtggaggacttaagacttgaaagacacacatcataaatcaaagcactgaggaattttattatctaaaaattatggatgtatattcagtaaaataagcagaacacagattgggaaaagatacttgtgatgtcttaaatcgacaaccaaataatatccaggatataaatgcaactcgtgaaaatttaatagaaaacacaggaaccctttctccaagaaacgcgcaggtgttatgtgaacagtcaataaagaagagggaaggcaaaatattaaggagcattggactgatgctccaactcattagttatcagagaaatgaagatgaacacaatgtacagtcatttacactgaataggttggcagagaaataagaaagctaggtagtgctactccagggcagagctggggagctctagaaactcacctgcagctcgggagcatggactagtgcaggcattttgcaaaacaatctgttatacttagtccaactaatctaatgtaaacccagacattcaactccaatttatagtccagagaacttctcacagggccctctgggtgaaagtgtatcagaacatcataggcagtagcggtgatttggagacagtctgctcaccgattacggggtaatggataacaaaagtgtagactatgatgcaaagcttagaagtaatgtgtgaaatgtacatacagtaatctggatggaagttaaaaaaatagtactgattgaaaaaaaaagggtgaagtagaatgagtgataaatgatttatccgtgtacgtttaaaatactcagattaacaaagtaaatttttcctgaacacaaacaaagcagtgtaaattaaatgtattaagtgggcagtggggttggggagggacacgggagcagagaagaaggagataagagggttactcaataaaagaaacaagcaggagtgctttgtgtaccaatgtgattgaatgctataaactgtggcccatcattaactcaactacctgcactagagatcaacagaaaagtcaggttcatctcacctccatgaaataaatcttggagaactatccatgtgaagaggcacctgtttattcatctgcttagagccatgtgtaaacacatgcccctcagtggcaaaccctcgccacagctggtgaatgggaggggaaggttgtggtttatgtgatgcacagtctctagtagccagctgcgacaacactgccttatttcccattgatcagacacacctagggcatctcaacactactgtggaaaatcgtggtagtgggtcaagaaaatctccagggcagatatctactttgatttatttctatctcaaaaattaatggaataaatacttcaaaactttgccaaaagtgcttagacaaagaccagactgtttgtttcaaattgaaaatgggcatgaactgtgaatggctcgagattttgtaatttttaggaagactgtgggctaatttgcaattgaaaaatcacgagagccatttatagaatgaccactctgtattgaatagctatcgctttgtcttctgtacgccccttgcttttgtgaattgtcactctcctccatgttatcctgataggttgccaatcacctccccaactttcttgccataggggtacgtatgtgactttaggaaggacagtgagagcctgccattaaagactagaagtatctccagaccaccgttccaatttcttgaagggactcactagcaaatgaaaataacaaagagaaaagcagtgatgtgagtgggaagggaaaggggagagagggagagagggaggaaatgaagataggcataaggcaaatgccacccctgagcttttaaattatatgaaccatgaaattattctttggattagggtttttttt
